United States Patent
Davila

(10) Patent No.: US 12,036,242 B2
(45) Date of Patent: Jul. 16, 2024

(54) CAR T CELLS THAT TARGET B-CELL ANTIGENS

(71) Applicant: H. Lee Moffitt Cancer Center and Research Institute, Inc., Tampa, FL (US)

(72) Inventor: Marco L. Davila, Tampa, FL (US)

(73) Assignee: H. Lee Moffitt Cancer Center and Research Institute, Inc., Tampa, FL (US)

( * ) Notice: Subject to any disclaimer, the term of this patent is extended or adjusted under 35 U.S.C. 154(b) by 736 days.

(21) Appl. No.: 17/059,745

(22) PCT Filed: Jul. 3, 2019

(86) PCT No.: PCT/US2019/040564
§ 371 (c)(1),
(2) Date: Nov. 30, 2020

(87) PCT Pub. No.: WO2020/010235
PCT Pub. Date: Jan. 9, 2020

(65) Prior Publication Data
US 2021/0205362 A1    Jul. 8, 2021

Related U.S. Application Data

(60) Provisional application No. 62/791,069, filed on Jan. 11, 2019, provisional application No. 62/748,733, filed on Oct. 22, 2018, provisional application No. 62/748,731, filed on Oct. 22, 2018, provisional application No. 62/748,721, filed on Oct. 22, 2018, provisional application No. 62/748,717, filed on Oct. 22, 2018, provisional application No. 62/747,834, filed on Oct. 19, 2018, provisional application No. 62/747,833, filed on Oct. 19, 2018, provisional application No. 62/736,836, filed on Sep. 26, 2018, provisional application No. 62/736,827, filed on Sep. 26, 2018, provisional application No. 62/694,095, filed on Jul. 5, 2018, provisional application No. 62/694,092, filed on Jul. 5, 2018, provisional application No. 62/694,090, filed on Jul. 5, 2018, provisional application No. 62/694,094, filed on Jul. 5, 2018.

(51) Int. Cl.
*A61K 35/17* (2015.01)
*C07K 14/705* (2006.01)
*C07K 16/28* (2006.01)
*A61K 39/00* (2006.01)

(52) U.S. Cl.
CPC ........ *A61K 35/17* (2013.01); *C07K 14/70596* (2013.01); *C07K 16/2803* (2013.01); *A61K 2039/505* (2013.01); *C07K 2317/31* (2013.01); *C07K 2317/565* (2013.01); *C07K 2317/622* (2013.01)

(58) Field of Classification Search
None
See application file for complete search history.

(56) References Cited

U.S. PATENT DOCUMENTS

| | | | |
|---|---|---|---|
| 11,180,536 B2 * | 11/2021 | Yang | A23L 21/00 |
| 2006/0269977 A1 | 11/2006 | Sawadaishi et al. | |
| 2008/0260738 A1 | 10/2008 | Moore et al. | |
| 2009/0041717 A1 | 2/2009 | Macdonald et al. | |
| 2012/0058906 A1 | 3/2012 | Smider et al. | |
| 2013/0022623 A1 | 1/2013 | Karsunky et al. | |
| 2016/0362472 A1 | 12/2016 | Bitter et al. | |
| 2017/0021020 A1 | 1/2017 | Bollyky et al. | |
| 2017/0306015 A1 | 10/2017 | Altevogt et al. | |

OTHER PUBLICATIONS

Shao et al., Medicine 97:12 (Year: 2018).*
Tuscano et al. Cancer Res., 72(21):5556-65 (Year: 2012).*
Sermer & Brentjens, Hematological Oncology. 37(S1):95-100; DOI: 10.1002/hon.2591. (Year: 2019).*
International Search Report issued for PCT/US2019/040564, mailed Nov. 26, 2019.

* cited by examiner

*Primary Examiner* — Jessica H Roark
(74) *Attorney, Agent, or Firm* — Thomas | Horstemeyer, LLP

(57) ABSTRACT

Disclosed are compositions and methods for targeted treatment of myeloid and B cell malignancies. In particular, chimeric antigen receptor (CAR) T cells are disclosed that can be used with adoptive cell transfer to target and kill myeloid and B cell malignancies with reduced antigen escape. Therefore, also disclosed are methods of providing an anti-tumor immunity in a subject with a myeloid and B cell malignancies that involves adoptive transfer of the disclosed CAR T cells.

6 Claims, 6 Drawing Sheets
Specification includes a Sequence Listing.

CAR T CELLS THAT TARGET B-CELL ANTIGENS

CROSS-REFERENCE TO RELATED APPLICATIONS

This application is a National Stage of International Application No. PCT/US2019/040564, filed Jul. 3, 2019, which claims benefit of U.S. Provisional Application No. 62/694,092, filed Jul. 5, 2018, U.S. Provisional Application No. 62/694,094, filed Jul. 5, 2018, U.S. Provisional Application No. 62/694,095, filed Jul. 5, 2018, U.S. Provisional Application No. 62/694,090, filed Jul. 5, 2018, U.S. Provisional Application No. 62/736,827, filed Sep. 26, 2018, U.S. Provisional Application No. 62/736,836, filed Sep. 26, 2018, U.S. Provisional Application No. 62/747,834, filed Oct. 19, 2018, U.S. Provisional Application No. 62/747,833, filed Oct. 19, 2018, U.S. Provisional Application No. 62/748,733, filed Oct. 22, 2018, U.S. Provisional Application No. 62/748,731, filed Oct. 22, 2018, U.S. Provisional Application No. 62/748,717, filed Oct. 22, 2018, U.S. Provisional Application No. 62/748,721, filed Oct. 22, 2018, U.S. Provisional Application No. 62/791,069, filed Jan. 11, 2019, which are all hereby incorporated herein by reference in their entireties.

BACKGROUND

A major advance for T cell therapy was the chimeric antigen receptor (CAR), which is a single chain variable fragment (scFv) derived from an antibody fused to signaling domains from a T cell receptor (TCR). CAR designs that include a co-stimulatory domain, such as CD28 or 41BB, enhance in vivo CAR T cell function. The therapeutic promise of CAR T cells was realized when complete remission (CR) vrates of 90% were reported after treating B cell acute lymphoblastic leukemia (B-ALL) with CD19-targeted CAR T cells. In fact, there are 3 new FDA-approved indications for CD19-targeted CAR T cells. However, with increasing numbers of patients treated, challenges have become evident, such as high relapse rates for B-ALL and/or low response rates for Diffuse Large B cell Lymphoma (DLBCL). Some of these poor outcomes may be attributed to CAR design, for example CD28 is associated with T cell exhaustion, and/or CAR production since the outcome of patients treated with 41BB-based CAR T cells correlate with T cell quality, which is associated with memory T cell phenotypes. Furthermore, despite the success of CAR T cells for B cell malignancies it remains to be seen if these outcomes will be translated to other malignancies.

SUMMARY

The disclosed compositions and methods are based on efforts to rationally optimize co-stimulation to reduce CAR T cell exhaustion and enhance persistence, to develop an AAPC system that enhances production of enriched memory CAR T cells, and to develop mono- and multi-antigen targeted CARs for myeloid malignancies and B cell malignancies to prevent antigen escape.

CAR polypeptides are disclosed that can be used with adoptive cell transfer to target and kill B cell malignancies with reduced antigen escape. The disclosed CAR polypeptides contain in an ectodomain an anti-CD19 binding agent, anti-CD20 binding agent, and/or an anti-CD22 binding agent that can bind CD19, CD20, and/or CD22-expressing cancer cells. Also disclosed is an immune effector cell genetically modified to express the disclosed CAR polypeptide.

CAR T cells are disclosed that can be used with adoptive cell transfer to target and kill myeloid or B cell malignancies with reduced antigen escape. The CAR T cells are immune effector cells transfected with nucleic acids encoding one or more CAR polypeptides that selectively bind one, two, three, or more B cell antigens. The immune effector can be selected from the group consisting of an alpha-beta T cells, a gamma-delta T cell, a Natural Killer (NK) cells, a Natural Killer T (NKT) cell, a B cell, an innate lymphoid cell (ILC), a cytokine induced killer (CIK) cell, a cytotoxic T lymphocyte (CTL), an autologous or allogeneic EBV-sensitized CTL, a lymphokine activated killer (LAK) cell, and a regulatory T cell.

In some embodiments, the CAR T cell contains CAR polypeptides that selectively bind a B cell antigen. The disclosed CAR polypeptides can therefore contain in an ectodomain a B cell antigen-binding agent.

The B cell antigen-binding agent is in some embodiments an antibody fragment that specifically binds CD19. For example, the antigen binding domain can be a Fab or a single-chain variable fragment (scFv) of an antibody that specifically binds CD19. The anti-CD19 binding agent is in some embodiments an aptamer that specifically binds CD19. For example, the anti-CD19 binding agent can be a peptide aptamer selected from a random sequence pool based on its ability to bind CD19.

The anti-CD19 binding agent can also be a natural ligand of CD19, or a variant and/or fragment thereof capable of binding CD19.

The B cell antigen-binding agent is in some embodiments an antibody fragment that specifically binds CD20. For example, the antigen binding domain can be a Fab or a single-chain variable fragment (scFv) of an antibody that specifically binds CD20. The anti-CD20 binding agent is in some embodiments an aptamer that specifically binds CD20. For example, the anti-CD20 binding agent can be a peptide aptamer selected from a random sequence pool based on its ability to bind CD20. The anti-CD20 binding agent can also be a natural ligand of CD20, or a variant and/or fragment thereof capable of binding CD20.

The B cell antigen-binding agent is in some embodiments an antibody fragment that specifically binds CD22. For example, the antigen binding domain can be a Fab or a single-chain variable fragment (scFv) of an antibody that specifically binds CD22. The anti-CD22 binding agent is in some embodiments an aptamer that specifically binds CD22. For example, the anti-CD22 binding agent can be a peptide aptamer selected from a random sequence pool based on its ability to bind CD22. The anti-CD22 binding agent can also be a natural ligand of CD22, or a variant and/or fragment thereof capable of binding CD22.

In some embodiments, the CAR T cell contains CAR polypeptides that selectively bind CD19, CAR polypeptides that selectively bind CD20, and CAR polypeptides that selectively bind CD22. In some embodiments, the CAR T cell contains CAR polypeptides that selectively bind CD19 and CAR polypeptides that selectively bind CD20. In some embodiments, the CAR T cell contains CAR polypeptides that selectively bind CD19 and CAR polypeptides that selectively bind CD22. In some embodiments, the CAR T cell contains CAR polypeptides that selectively bind CD20 and CAR polypeptides that selectively bind CD22.

As with other CARs, the disclosed polypeptides can also contain a transmembrane domain and an endodomain capable of activating an immune effector cell. For example, the endodomain can contain a signaling domain and one or more co-stimulatory signaling regions.

In some embodiments, the intracellular signaling domain is a CD3 zeta (CD3ζ) signaling domain. In some embodiments, the costimulatory signaling region comprises the cytoplasmic domain of CD28, 4-1BB, or a combination thereof. In some cases, the costimulatory signaling region contains 1, 2, 3, or 4 cytoplasmic domains of one or more intracellular signaling and/or costimulatory molecules. In some embodiments, the co-stimulatory signaling region contains one or more mutations in the cytoplasmic domains of CD28 and/or 4-1BB that enhance signaling.

In some embodiments, the CAR polypeptide contains an incomplete endodomain. For example, the CAR polypeptide can contain only an intracellular signaling domain or a co-stimulatory domain, but not both. In these embodiments, the immune effector cell is not activated unless it and a second CAR polypeptide (or endogenous T-cell receptor) that contains the missing domain both bind their respective antigens. Therefore, in some embodiments, the CAR polypeptide contains a CD3 zeta (CD3ζ) signaling domain but does not contain a costimulatory signaling region (CSR). In other embodiments, the CAR polypeptide contains the cytoplasmic domain of CD28, 4-1BB, or a combination thereof, but does not contain a CD3 zeta (CD3ζ) signaling domain (SD).

Also disclosed are isolated nucleic acid sequences encoding the disclosed CAR polypeptides, vectors comprising these isolated nucleic acids, cells containing these vectors, and cells comprising one or more of the herein described CAR polypeptides.

In some embodiments, the disclosed CAR T cell exhibits an anti-tumor immunity when the antigen binding domain of a CAR polypeptides binds to CD19, CD20, and/or CD22.

Also disclosed is a method of providing an anti-tumor immunity in a subject with a myeloid or B cell malignancies that involves administering to the subject an effective amount of a CAR T cell disclosed herein. In some cases, the myeloid or B cell malignancies comprises Acute Myeloid Leukemia (AML), blastic plasmocytoid dendritic cell neoplasm, hairy cell leukemia, or Acute Lymphoblastic Leukemia.

The details of one or more embodiments of the invention are set forth in the accompanying drawings and the description below. Other features, objects, and advantages of the invention will be apparent from the description and drawings, and from the claims.

DETAILED DESCRIPTION

Figure 1B:
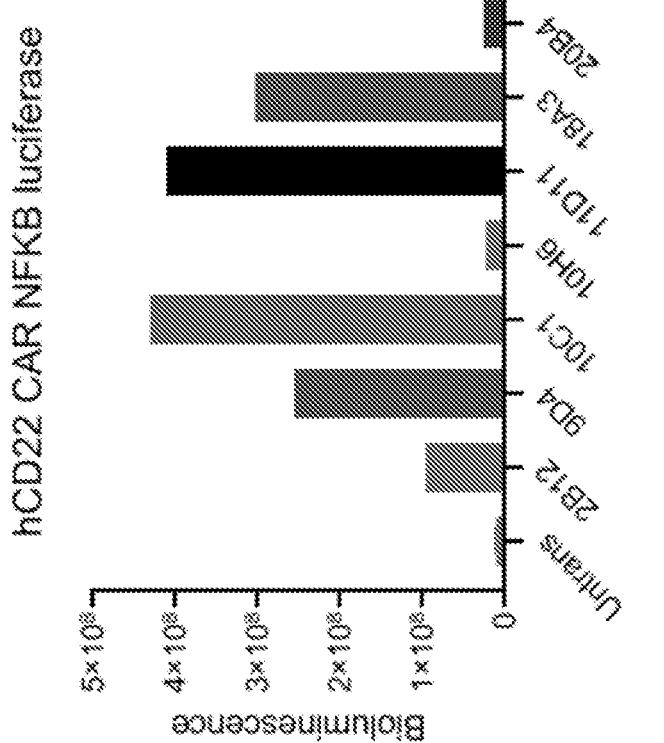
FIGS. 1A and 1B contain bar graphs showing CAR candidates activate NFKB. NFKB reporter cells were transduced with γ-retrovirus containing CD19 (FIG. 1A) or CD22 (FIG. 1B) CARs. Cell lysates from transduced or untransduced cells were used for luciferase assay. Bioluminescence indicates the level of NFKB activation. h19BBzGFP, positive control; 1A10 etc., hybridoma cell IDs from which CAR scFvs were derived.

Disclosed herein are immune effector cells, such as T cells or Natural Killer (NK) cells, that are engineered to express CAR polypeptides that selectively bind B cell antigens (BCAs). Therefore, also disclosed are methods for providing an anti-tumor immunity in a subject with myeloid or B cell malignancies that involves adoptive transfer of the disclosed immune effector cells engineered to express the disclosed CAR polypeptides.

Chimeric Antigen Receptors (CAR)

Disclosed herein is a chimeric antigen receptor (CAR) polypeptide that can be that can be expressed in immune effector cells to enhance antitumor activity against myeloid or B cell malignancies.

The disclosed CAR is generally made up of three domains: an ectodomain, a transmembrane domain, and an endodomain. The ectodomain comprises a CD19-binding region, a CD20-binding region, or a CD22-binding region and is responsible for antigen recognition. It also optionally contains a signal peptide (SP) so that the CAR can be glycosylated and anchored in the cell membrane of the immune effector cell. The transmembrane domain (TD), is as its name suggests, connects the ectodomain to the endodomain and resides within the cell membrane when expressed by a cell. The endodomain is the business end of the CAR that transmits an activation signal to the immune effector cell after antigen recognition. For example, the endodomain can contain an intracellular signaling domain (ISD) and optionally a co-stimulatory signaling region (CSR).

A "signaling domain (SD)" generally contains immunoreceptor tyrosine-based activation motifs (ITAMs) that activate a signaling cascade when the ITAM is phosphorylated. The term "co-stimulatory signaling region (CSR)" refers to intracellular signaling domains from costimulatory protein receptors, such as CD28, 41BB, and ICOS, that are able to enhance T-cell activation by T-cell receptors.

In some embodiments, the endodomain contains an SD or a CSR, but not both. In these embodiments, an immune effector cell containing the disclosed CAR is only activated if another CAR (or a T-cell receptor) containing the missing domain also binds its respective antigen.

In some embodiments, the disclosed CAR is defined by the formula:

SP-BCA-HG-TM-CSR-SD; or

SP-BCA-HG-TM-SD-CSR;

wherein "SP" represents an optional signal peptide,
wherein "BCA" represents a B cell antigen binding region,
wherein "HG" represents an optional hinge domain,
wherein "TM" represents a transmembrane domain,
wherein "CSR" represents one or more co-stimulatory signaling regions,
wherein "SD" represents a signaling domain, and
wherein "-" represents a peptide bond or linker.

Additional CAR constructs are described, for example, in Fresnak A D, et al. Engineered T cells: the promise and challenges of cancer immunotherapy. Nat Rev Cancer. 2016 Aug. 23; 16(9):566-81, which is incorporated by reference in its entirety for the teaching of these CAR models.

For example, the CAR can be a TRUCK, Universal CAR, Self-driving CAR, Armored CAR, Self-destruct CAR, Conditional CAR, Marked CAR, TenCAR, Dual CAR, or sCAR.

TRUCKs (T cells redirected for universal cytokine killing) co-express a chimeric antigen receptor (CAR) and an antitumor cytokine. Cytokine expression may be constitutive or induced by T cell activation. Targeted by CAR specificity, localized production of pro-inflammatory cytokines recruits endogenous immune cells to tumor sites and may potentiate an antitumor response.

Universal, allogeneic CAR T cells are engineered to no longer express endogenous T cell receptor (TCR) and/or major histocompatibility complex (MHC) molecules, thereby preventing graft-versus-host disease (GVHD) or rejection, respectively.

Self-driving CARs co-express a CAR and a chemokine receptor, which binds to a tumor ligand, thereby enhancing tumor homing.

CAR T cells engineered to be resistant to immunosuppression (Armored CARs) may be genetically modified to no longer express various immune checkpoint molecules (for example, cytotoxic T lymphocyte-associated antigen 4 (CTLA4) or programmed cell death protein 1 (PD1)), with an immune checkpoint switch receptor, or may be administered with a monoclonal antibody that blocks immune checkpoint signaling.

A self-destruct CAR may be designed using RNA delivered by electroporation to encode the CAR. Alternatively, inducible apoptosis of the T cell may be achieved based on ganciclovir binding to thymidine kinase in gene-modified lymphocytes or the more recently described system of activation of human caspase 9 by a small-molecule dimerizer.

A conditional CAR T cell is by default unresponsive, or switched 'off', until the addition of a small molecule to complete the circuit, enabling full transduction of both signal 1 and signal 2, thereby activating the CAR T cell. Alternatively, T cells may be engineered to express an adaptor-specific receptor with affinity for subsequently administered secondary antibodies directed at target antigen.

Marked CAR T cells express a CAR plus a tumor epitope to which an existing monoclonal antibody agent binds. In the setting of intolerable adverse effects, administration of the monoclonal antibody clears the CAR T cells and alleviates symptoms with no additional off-tumor effects.

A tandem CAR (TanCAR) T cell expresses a single CAR consisting of two linked single-chain variable fragments (scFvs) that have different affinities fused to intracellular co-stimulatory domain(s) and a CD3 domain. TanCAR T cell activation is achieved only when target cells co-express both targets.

A dual CAR T cell expresses two separate CARs with different ligand binding targets; one CAR includes only the CD3 domain and the other CAR includes only the co-stimulatory domain(s). Dual CAR T cell activation requires co-expression of both targets on the tumor.

A safety CAR (sCAR) consists of an extracellular scFv fused to an intracellular inhibitory domain. sCAR T cells co-expressing a standard CAR become activated only when encountering target cells that possess the standard CAR target but lack the sCAR target.

The antigen recognition domain of the disclosed CAR is usually an scFv. There are however many alternatives. An antigen recognition domain from native T-cell receptor (TCR) alpha and beta single chains have been described, as have simple ectodomains (e.g. CD4 ectodomain to recognize HIV infected cells) and more exotic recognition components such as a linked cytokine (which leads to recognition of cells bearing the cytokine receptor). In fact almost anything that binds a given target with high affinity can be used as an antigen recognition region.

The endodomain is the business end of the CAR that after antigen recognition transmits a signal to the immune effector cell, activating at least one of the normal effector functions of the immune effector cell. Effector function of a T cell, for example, may be cytolytic activity or helper activity including the secretion of cytokines. Therefore, the endodomain may comprise the "intracellular signaling domain" of a T cell receptor (TCR) and optional co-receptors. While usually the entire intracellular signaling domain can be employed, in many cases it is not necessary to use the entire chain. To the extent that a truncated portion of the intracellular signaling domain is used, such truncated portion may be used in place of the intact chain as long as it transduces the effector function signal.

Cytoplasmic signaling sequences that regulate primary activation of the TCR complex that act in a stimulatory manner may contain signaling motifs which are known as immunoreceptor tyrosine-based activation motifs (ITAMs). Examples of ITAM containing cytoplasmic signaling sequences include those derived from CD8, CD3ζ, CD3δ, CD3γ, CD3ε, CD32 (Fc gamma RIIa), DAP10, DAP12, CD79a, CD79b, FcγRIγ, FcγRIIIγ, FcεRIβ (FCERIB), and FcεRIγ (FCERIG). Variant CD3ζ signaling domains lacking one or more ITAM domains may also find use in the herein described CARs. Such variant CD3ζ signaling domains include those described by Bridgeman et al., *Clin. Exp. Immunol.* 175:258-267 (2013), which is herein incorporated by reference.

In particular embodiments, the intracellular signaling domain is derived from CD3 zeta (CD3ζ) (TCR zeta, GenBank accno. BAG36664.1). T-cell surface glycoprotein CD3 zeta (CD3) chain, also known as T-cell receptor T3 zeta chain or CD247 (Cluster of Differentiation 247), is a protein that in humans is encoded by the CD247 gene.

First-generation CARs typically had the intracellular domain from the CD3ζ chain, which is the primary transmitter of signals from endogenous TCRs. Second-generation CARs add intracellular signaling domains from various costimulatory protein receptors (e.g., CD28, 41BB, ICOS) to the endodomain of the CAR to provide additional signals to the T cell. Preclinical studies have indicated that the second generation of CAR designs improves the antitumor activity of T cells. More recent, third-generation CARs combine multiple signaling domains to further augment potency. T cells grafted with these CARs have demonstrated improved expansion, activation, persistence, and tumor-eradicating efficiency independent of costimulatory receptor/ligand interaction (Imai C, et al. Leukemia 2004 18:676-84; Maher J, et al. Nat Biotechnol 2002 20:70-5).

For example, the endodomain of the CAR can be designed to comprise the CD3ζ signaling domain by itself or combined with any other desired cytoplasmic domain(s) useful in the context of the CAR of the invention. For example, the cytoplasmic domain of the CAR can comprise a CD3ζ chain portion and a costimulatory signaling region. The costimulatory signaling region refers to a portion of the CAR comprising the intracellular domain of a costimulatory molecule. A costimulatory molecule is a cell surface molecule other than an antigen receptor or their ligands that is required for an efficient response of lymphocytes to an antigen. Examples of such molecules include CD27, CD28, 4-1BB (CD137), OX40, CD30, CD40, ICOS, lymphocyte function-associated antigen-1 (LFA-1), CD2, CD7, LIGHT, NKG2C, B7-H3, and a ligand that specifically binds with CD83, CD8, CD4, b2c, CD80, CD86, DAP10, DAP12, MyD88, BTNL3, and NKG2D. Thus, while the CAR is exemplified primarily with CD28 as the co-stimulatory signaling element, other costimulatory elements can be used alone or in combination with other co-stimulatory signaling elements.

In some embodiments, the CAR comprises a hinge sequence. A hinge sequence is a short sequence of amino acids that facilitates antibody flexibility (see, e.g., Woof et al., Nat. Rev. Immunol., 4(2): 89-99 (2004)). The hinge sequence may be positioned between the antigen recognition moiety (e.g., anti-CD19, -CD20, or -CD22 scFv) and the transmembrane domain. The hinge sequence can be any suitable sequence derived or obtained from any suitable molecule. In some embodiments, for example, the hinge sequence is derived from a CD8a molecule or a CD28 molecule.

The transmembrane domain may be derived either from a natural or from a synthetic source. Where the source is natural, the domain may be derived from any membrane-bound or transmembrane protein. For example, the transmembrane region may be derived from (i.e. comprise at least the transmembrane region(s) of) the alpha, beta or zeta chain of the T-cell receptor, CD28, CD3 epsilon, CD45, CD4, CD5, CD8 (e.g., CD8 alpha, CD8 beta), CD9, CD16, CD22, CD33, CD37, CD64, CD80, CD86, CD134, CD137, or CD154, KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), CD160, CD19, IL2R beta, IL2R gamma, IL7R α, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, and PAG/Cbp. Alternatively the transmembrane domain may be synthetic, in which case it will comprise predominantly hydrophobic residues such as leucine and valine. In some cases, a triplet of phenylalanine, tryptophan and valine will be found at each end of a synthetic transmembrane domain. A short oligo- or polypeptide linker, such as between 2 and 10 amino acids in length, may form the linkage between the transmembrane domain and the endoplasmic domain of the CAR.

In some embodiments, the CAR has more than one transmembrane domain, which can be a repeat of the same transmembrane domain, or can be different transmembrane domains.

In some embodiments, the CAR is a multi-chain CAR, as described in WO2015/039523, which is incorporated by reference for this teaching. A multi-chain CAR can comprise separate extracellular ligand binding and signaling domains in different transmembrane polypeptides. The signaling domains can be designed to assemble in juxtamembrane position, which forms flexible architecture closer to natural receptors, that confers optimal signal transduction. For example, the multi-chain CAR can comprise a part of an FCERI alpha chain and a part of an FCERI beta chain such that the FCERI chains spontaneously dimerize together to form a CAR.

Tables 1, 2, and 3 below provide some example combinations of BCA-binding region, co-stimulatory signaling regions, and intracellular signaling domain that can occur in the disclosed CARs.

TABLE 1

First Generation CARs

| ScFv | Signal Domain |
|------|---------------|
| BCA | CD8 |
| BCA | CD3ζ |
| BCA | CD3δ |
| BCA | CD3γ |
| BCA | CD3ε |
| BCA | FcγRI-γ |
| BCA | FcγRIII-γ |
| BCA | FcεRIβ |
| BCA | FcεRIγ |
| BCA | DAP10 |
| BCA | DAP12 |
| BCA | CD32 |
| BCA | CD79a |

TABLE 2

Second Generation CARs

| ScFv | Co-stimulatory Signal | Signal Domain | ScFv | Co-stimulatory Signal | Signal Domain |
|------|----------------------|---------------|------|----------------------|---------------|
| BCA | CD28 | CD8 | BCA | CD80 | FcεRIβ |
| BCA | CD28 | CD3ζ | BCA | CD80 | FcεRIγ |
| BCA | CD28 | CD3δ | BCA | CD80 | DAP10 |
| BCA | CD28 | CD3γ | BCA | CD80 | DAP12 |
| BCA | CD28 | CD3ε | BCA | CD80 | CD32 |
| BCA | CD28 | FcγRI-γ | BCA | CD80 | CD79a |
| BCA | CD28 | FcγRIII-γ | BCA | CD80 | CD79b |
| BCA | CD28 | FcεRIβ | BCA | CD86 | CD8 |
| BCA | CD28 | FcεRIγ | BCA | CD86 | CD3ζ |
| BCA | CD28 | DAP10 | BCA | CD86 | CD3δ |
| BCA | CD28 | DAP12 | BCA | CD86 | CD3γ |
| BCA | CD28 | CD32 | BCA | CD86 | CD3ε |
| BCA | CD28 | CD79a | BCA | CD86 | FcγRI-γ |
| BCA | CD28 | CD79b | BCA | CD86 | FcγRIII-γ |
| BCA | CD8 | CD8 | BCA | CD86 | FcεRIβ |
| BCA | CD8 | CD3ζ | BCA | CD86 | FcεRIγ |
| BCA | CD8 | CD3δ | BCA | CD86 | DAP10 |
| BCA | CD8 | CD3γ | BCA | CD86 | DAP12 |
| BCA | CD8 | CD3ε | BCA | CD86 | CD32 |
| BCA | CD8 | FcγRI-γ | BCA | CD86 | CD79a |
| BCA | CD8 | FcγRIII-γ | BCA | CD86 | CD79b |
| BCA | CD8 | FcεRIβ | BCA | OX40 | CD8 |
| BCA | CD8 | FcεRIγ | BCA | OX40 | CD3ζ |
| BCA | CD8 | DAP10 | BCA | OX40 | CD3δ |
| BCA | CD8 | DAP12 | BCA | OX40 | CD3γ |
| BCA | CD8 | CD32 | BCA | OX40 | CD3ε |
| BCA | CD8 | CD79a | BCA | OX40 | FcγRI-γ |
| BCA | CD8 | CD79b | BCA | OX40 | FcγRIII-γ |
| BCA | CD4 | CD8 | BCA | OX40 | FcεRIβ |
| BCA | CD4 | CD3ζ | BCA | OX40 | FcεRIγ |
| BCA | CD4 | CD3δ | BCA | OX40 | DAP10 |
| BCA | CD4 | CD3γ | BCA | OX40 | DAP12 |
| BCA | CD4 | CD3ε | BCA | OX40 | CD32 |
| BCA | CD4 | FcγRI-γ | BCA | OX40 | CD79a |
| BCA | CD4 | FcγRIII-γ | BCA | OX40 | CD79b |
| BCA | CD4 | FcεRIβ | BCA | DAP10 | CD8 |
| BCA | CD4 | FcεRIγ | BCA | DAP10 | CD3ζ |
| BCA | CD4 | DAP10 | BCA | DAP10 | CD3δ |
| BCA | CD4 | DAP12 | BCA | DAP10 | CD3γ |
| BCA | CD4 | CD32 | BCA | DAP10 | CD3ε |
| BCA | CD4 | CD79a | BCA | DAP10 | FcγRI-γ |
| BCA | CD4 | CD79b | BCA | DAP10 | FcγRIII-γ |
| BCA | b2c | CD8 | BCA | DAP10 | FcεRIβ |

TABLE 2-continued

Second Generation CARs

| ScFv | Co-stimulatory Signal | Signal Domain | ScFv | Co-stimulatory Signal | Signal Domain |
|---|---|---|---|---|---|
| BCA | b2c | CD3ζ | BCA | DAP10 | FcεRIγ |
| BCA | b2c | CD3δ | BCA | DAP10 | DAP10 |
| BCA | b2c | CD3γ | BCA | DAP10 | DAP12 |
| BCA | b2c | CD3ε | BCA | DAP10 | CD32 |
| BCA | b2c | FcγRI-γ | BCA | DAP10 | CD79a |
| BCA | b2c | FcγRIII-γ | BCA | DAP10 | CD79b |
| BCA | b2c | FcεRIβ | BCA | DAP12 | CD8 |
| BCA | b2c | FcεRIγ | BCA | DAP12 | CD3ζ |
| BCA | b2c | DAP10 | BCA | DAP12 | CD3δ |
| BCA | b2c | DAP12 | BCA | DAP12 | CD3γ |
| BCA | b2c | CD32 | BCA | DAP12 | CD3ε |
| BCA | b2c | CD79a | BCA | DAP12 | FcγRI-γ |
| BCA | b2c | CD79b | BCA | DAP12 | FcγRIII-γ |
| BCA | CD137/41BB | CD8 | BCA | DAP12 | FcεRIβ |
| BCA | CD137/41BB | CD3ζ | BCA | DAP12 | FcεRIγ |
| BCA | CD137/41BB | CD3δ | BCA | DAP12 | DAP10 |
| BCA | CD137/41BB | CD3γ | BCA | DAP12 | DAP12 |
| BCA | CD137/41BB | CD3ε | BCA | DAP12 | CD32 |
| BCA | CD137/41BB | FcγRI-γ | BCA | DAP12 | CD79a |
| BCA | CD137/41BB | FcγRIII-γ | BCA | DAP12 | CD79b |
| BCA | CD137/41BB | FcεRIβ | BCA | MyD88 | CD8 |
| BCA | CD137/41BB | FcεRIγ | BCA | MyD88 | CD3ζ |
| BCA | CD137/41BB | DAP10 | BCA | MyD88 | CD3δ |
| BCA | CD137/41BB | DAP12 | BCA | MyD88 | CD3γ |
| BCA | CD137/41BB | CD32 | BCA | MyD88 | CD3ε |
| BCA | CD137/41BB | CD79a | BCA | MyD88 | FcγRI-γ |
| BCA | CD137/41BB | CD79b | BCA | MyD88 | FcγRIII-γ |
| BCA | ICOS | CD8 | BCA | MyD88 | FcεRIβ |
| BCA | ICOS | CD3ζ | BCA | MyD88 | FcεRIγ |
| BCA | ICOS | CD3δ | BCA | MyD88 | DAP10 |
| BCA | ICOS | CD3γ | BCA | MyD88 | DAP12 |
| BCA | ICOS | CD3ε | BCA | MyD88 | CD32 |
| BCA | ICOS | FcγRI-γ | BCA | MyD88 | CD79a |
| BCA | ICOS | FcγRIII-γ | BCA | MyD88 | CD79b |
| BCA | ICOS | FcεRIβ | BCA | CD7 | CD8 |
| BCA | ICOS | FcεRIγ | BCA | CD7 | CD3ζ |
| BCA | ICOS | DAP10 | BCA | CD7 | CD3δ |
| BCA | ICOS | DAP12 | BCA | CD7 | CD3γ |
| BCA | ICOS | CD32 | BCA | CD7 | CD3ε |
| BCA | ICOS | CD79a | BCA | CD7 | FcγRI-γ |
| BCA | ICOS | CD79b | BCA | CD7 | FcγRIII-γ |
| BCA | CD27 | CD8 | BCA | CD7 | FcεRIβ |
| BCA | CD27 | CD3ζ | BCA | CD7 | FcεRIγ |
| BCA | CD27 | CD3δ | BCA | CD7 | DAP10 |
| BCA | CD27 | CD3γ | BCA | CD7 | DAP12 |
| BCA | CD27 | CD3ε | BCA | CD7 | CD32 |
| BCA | CD27 | FcγRI-γ | BCA | CD7 | CD79a |
| BCA | CD27 | FcγRIII-γ | BCA | CD7 | CD79b |
| BCA | CD27 | FcεRIβ | BCA | BTNL3 | CD8 |
| BCA | CD27 | FcεRIγ | BCA | BTNL3 | CD3ζ |
| BCA | CD27 | DAP10 | BCA | BTNL3 | CD3δ |
| BCA | CD27 | DAP12 | BCA | BTNL3 | CD3γ |
| BCA | CD27 | CD32 | BCA | BTNL3 | CD3ε |
| BCA | CD27 | CD79a | BCA | BTNL3 | FcγRI-γ |
| BCA | CD27 | CD79b | BCA | BTNL3 | FcγRIII-γ |
| BCA | CD28δ | CD8 | BCA | BTNL3 | FcεRIβ |
| BCA | CD28δ | CD3ζ | BCA | BTNL3 | FcεRIγ |
| BCA | CD28δ | CD3δ | BCA | BTNL3 | DAP10 |
| BCA | CD28δ | CD3γ | BCA | BTNL3 | DAP12 |
| BCA | CD28δ | CD3ε | BCA | BTNL3 | CD32 |
| BCA | CD28δ | FcγRI-γ | BCA | BTNL3 | CD79a |
| BCA | CD28δ | FcγRIII-γ | BCA | BTNL3 | CD79b |
| BCA | CD28δ | FcεRIβ | BCA | NKG2D | CD8 |
| BCA | CD28δ | FcεRIγ | BCA | NKG2D | CD3ζ |
| BCA | CD28δ | DAP10 | BCA | NKG2D | CD3δ |
| BCA | CD28δ | DAP12 | BCA | NKG2D | CD3γ |
| BCA | CD28δ | CD32 | BCA | NKG2D | CD3ε |
| BCA | CD28δ | CD79a | BCA | NKG2D | FcγRI-γ |
| BCA | CD28δ | CD79b | BCA | NKG2D | FcγRIII-γ |
| BCA | CD80 | CD8 | BCA | NKG2D | FcεRIβ |
| BCA | CD80 | CD3ζ | BCA | NKG2D | FcεRIγ |
| BCA | CD80 | CD3δ | BCA | NKG2D | DAP10 |
| BCA | CD80 | CD3γ | BCA | NKG2D | DAP12 |
| BCA | CD80 | CD3ε | BCA | NKG2D | CD32 |
| BCA | CD80 | FcγRI-γ | BCA | NKG2D | CD79a |
| BCA | CD80 | FcγRIII-γ | BCA | NKG2D | CD79b |

TABLE 3

Third Generation CARs

| ScFv | Co-stimulatory Signal | Co-stimulatory Signal | Signal Domain |
|---|---|---|---|
| BCA | CD28 | CD28 | CD8 |
| BCA | CD28 | CD28 | CD3ζ |
| BCA | CD28 | CD28 | CD3δ |
| BCA | CD28 | CD28 | CD3γ |
| BCA | CD28 | CD28 | CD3ε |
| BCA | CD28 | CD28 | FcγRI-γ |
| BCA | CD28 | CD28 | FcγRIII-γ |
| BCA | CD28 | CD28 | FcεRIβ |
| BCA | CD28 | CD28 | FcεRIγ |
| BCA | CD28 | CD28 | DAP10 |
| BCA | CD28 | CD28 | DAP12 |
| BCA | CD28 | CD28 | CD32 |
| BCA | CD28 | CD28 | CD79a |
| BCA | CD28 | CD28 | CD79b |
| BCA | CD28 | CD8 | CD8 |
| BCA | CD28 | CD8 | CD3ζ |
| BCA | CD28 | CD8 | CD3δ |
| BCA | CD28 | CD8 | CD3γ |
| BCA | CD28 | CD8 | CD3ε |
| BCA | CD28 | CD8 | FcγRI-γ |
| BCA | CD28 | CD8 | FcγRIII-γ |
| BCA | CD28 | CD8 | FcεRIβ |
| BCA | CD28 | CD8 | FcεRIγ |
| BCA | CD28 | CD8 | DAP10 |
| BCA | CD28 | CD8 | DAP12 |
| BCA | CD28 | CD8 | CD32 |
| BCA | CD28 | CD8 | CD79a |
| BCA | CD28 | CD8 | CD79b |
| BCA | CD28 | CD4 | CD8 |
| BCA | CD28 | CD4 | CD3ζ |
| BCA | CD28 | CD4 | CD3δ |
| BCA | CD28 | CD4 | CD3γ |
| BCA | CD28 | CD4 | CD3ε |
| BCA | CD28 | CD4 | FcγRI-γ |
| BCA | CD28 | CD4 | FcγRIII-γ |
| BCA | CD28 | CD4 | FcεRIβ |
| BCA | CD28 | CD4 | FcεRIγ |
| BCA | CD28 | CD4 | DAP10 |
| BCA | CD28 | CD4 | DAP12 |
| BCA | CD28 | CD4 | CD32 |
| BCA | CD28 | CD4 | CD79a |
| BCA | CD28 | CD4 | CD79b |
| BCA | CD28 | b2c | CD8 |
| BCA | CD28 | b2c | CD3ζ |
| BCA | CD28 | b2c | CD3δ |
| BCA | CD28 | b2c | CD3γ |
| BCA | CD28 | b2c | CD3ε |
| BCA | CD28 | b2c | FcγRI-γ |
| BCA | CD28 | b2c | FcγRIII-γ |
| BCA | CD28 | b2c | FcεRIβ |
| BCA | CD28 | b2c | FcεRIγ |
| BCA | CD28 | b2c | DAP10 |
| BCA | CD28 | b2c | DAP12 |
| BCA | CD28 | b2c | CD32 |
| BCA | CD28 | b2c | CD79a |
| BCA | CD28 | b2c | CD79b |
| BCA | CD28 | CD137/41BB | CD8 |
| BCA | CD28 | CD137/41BB | CD3ζ |
| BCA | CD28 | CD137/41BB | CD3δ |
| BCA | CD28 | CD137/41BB | CD3γ |
| BCA | CD28 | CD137/41BB | CD3ε |
| BCA | CD28 | CD137/41BB | FcγRI-γ |
| BCA | CD28 | CD137/41BB | FcγRIII-γ |

TABLE 3-continued

Third Generation CARs

| ScFv | Co-stimulatory Signal | Co-stimulatory Signal | Signal Domain |
|---|---|---|---|
| BCA | CD28 | CD137/41BB | FcεRIβ |
| BCA | CD28 | CD137/41BB | FcεRIγ |
| BCA | CD28 | CD137/41BB | DAP10 |
| BCA | CD28 | CD137/41BB | DAP12 |
| BCA | CD28 | CD137/41BB | CD32 |
| BCA | CD28 | CD137/41BB | CD79a |
| BCA | CD28 | CD137/41BB | CD79b |
| BCA | CD28 | ICOS | CD8 |
| BCA | CD28 | ICOS | CD3ζ |
| BCA | CD28 | ICOS | CD3δ |
| BCA | CD28 | ICOS | CD3γ |
| BCA | CD28 | ICOS | CD3ε |
| BCA | CD28 | ICOS | FcγRI-γ |
| BCA | CD28 | ICOS | FcγRIII-γ |
| BCA | CD28 | ICOS | FcεRIβ |
| BCA | CD28 | ICOS | FcεRIγ |
| BCA | CD28 | ICOS | DAP10 |
| BCA | CD28 | ICOS | DAP12 |
| BCA | CD28 | ICOS | CD32 |
| BCA | CD28 | ICOS | CD79a |
| BCA | CD28 | ICOS | CD79b |
| BCA | CD28 | CD27 | CD8 |
| BCA | CD28 | CD27 | CD3ζ |
| BCA | CD28 | CD27 | CD3δ |
| BCA | CD28 | CD27 | CD3γ |
| BCA | CD28 | CD27 | CD3ε |
| BCA | CD28 | CD27 | FcγRI-γ |
| BCA | CD28 | CD27 | FcγRIII-γ |
| BCA | CD28 | CD27 | FcεRIβ |
| BCA | CD28 | CD27 | FcεRIγ |
| BCA | CD28 | CD27 | DAP10 |
| BCA | CD28 | CD27 | DAP12 |
| BCA | CD28 | CD27 | CD32 |
| BCA | CD28 | CD27 | CD79a |
| BCA | CD28 | CD27 | CD79b |
| BCA | CD28 | CD28δ | CD8 |
| BCA | CD28 | CD28δ | CD3ζ |
| BCA | CD28 | CD28δ | CD3δ |
| BCA | CD28 | CD28δ | CD3γ |
| BCA | CD28 | CD28δ | CD3ε |
| BCA | CD28 | CD28δ | FcγRI-γ |
| BCA | CD28 | CD28δ | FcγRIII-γ |
| BCA | CD28 | CD28δ | FcεRIβ |
| BCA | CD28 | CD28δ | FcεRIγ |
| BCA | CD28 | CD28δ | DAP10 |
| BCA | CD28 | CD28δ | DAP12 |
| BCA | CD28 | CD28δ | CD32 |
| BCA | CD28 | CD28δ | CD79a |
| BCA | CD28 | CD28δ | CD79b |
| BCA | CD28 | CD80 | CD8 |
| BCA | CD28 | CD80 | CD3ζ |
| BCA | CD28 | CD80 | CD3δ |
| BCA | CD28 | CD80 | CD3γ |
| BCA | CD28 | CD80 | CD3ε |
| BCA | CD28 | CD80 | FcγRI-γ |
| BCA | CD28 | CD80 | FcγRIII-γ |
| BCA | CD28 | CD80 | FcεRIβ |
| BCA | CD28 | CD80 | FcεRIγ |
| BCA | CD28 | CD80 | DAP10 |
| BCA | CD28 | CD80 | DAP12 |
| BCA | CD28 | CD80 | CD32 |
| BCA | CD28 | CD80 | CD79a |
| BCA | CD28 | CD80 | CD79b |
| BCA | CD28 | CD86 | CD8 |
| BCA | CD28 | CD86 | CD3ζ |
| BCA | CD28 | CD86 | CD3δ |
| BCA | CD28 | CD86 | CD3γ |
| BCA | CD28 | CD86 | CD3ε |
| BCA | CD28 | CD86 | FcγRI-γ |
| BCA | CD28 | CD86 | FcγRIII-γ |
| BCA | CD28 | CD86 | FcεRIβ |
| BCA | CD28 | CD86 | FcεRIγ |
| BCA | CD28 | CD86 | DAP10 |
| BCA | CD28 | CD86 | DAP12 |
| BCA | CD28 | CD86 | CD32 |
| BCA | CD28 | CD86 | CD79a |
| BCA | CD28 | CD86 | CD79b |
| BCA | CD28 | OX40 | CD8 |
| BCA | CD28 | OX40 | CD3ζ |
| BCA | CD28 | OX40 | CD3δ |
| BCA | CD28 | OX40 | CD3γ |
| BCA | CD28 | OX40 | CD3ε |
| BCA | CD28 | OX40 | FcγRI-γ |
| BCA | CD28 | OX40 | FcγRIII-γ |
| BCA | CD28 | OX40 | FcεRIβ |
| BCA | CD28 | OX40 | FcεRIγ |
| BCA | CD28 | OX40 | DAP10 |
| BCA | CD28 | OX40 | DAP12 |
| BCA | CD28 | OX40 | CD32 |
| BCA | CD28 | OX40 | CD79a |
| BCA | CD28 | OX40 | CD79b |
| BCA | CD28 | DAP10 | CD8 |
| BCA | CD28 | DAP10 | CD3ζ |
| BCA | CD28 | DAP10 | CD3δ |
| BCA | CD28 | DAP10 | CD3γ |
| BCA | CD28 | DAP10 | CD3ε |
| BCA | CD28 | DAP10 | FcγRI-γ |
| BCA | CD28 | DAP10 | FcγRIII-γ |
| BCA | CD28 | DAP10 | FcεRIβ |
| BCA | CD28 | DAP10 | FcεRIγ |
| BCA | CD28 | DAP10 | DAP10 |
| BCA | CD28 | DAP10 | DAP12 |
| BCA | CD28 | DAP10 | CD32 |
| BCA | CD28 | DAP10 | CD79a |
| BCA | CD28 | DAP10 | CD79b |
| BCA | CD28 | DAP12 | CD8 |
| BCA | CD28 | DAP12 | CD3ζ |
| BCA | CD28 | DAP12 | CD3δ |
| BCA | CD28 | DAP12 | CD3γ |
| BCA | CD28 | DAP12 | CD3ε |
| BCA | CD28 | DAP12 | FcγRI-γ |
| BCA | CD28 | DAP12 | FcγRIII-γ |
| BCA | CD28 | DAP12 | FcεRIβ |
| BCA | CD28 | DAP12 | FcεRIγ |
| BCA | CD28 | DAP12 | DAP10 |
| BCA | CD28 | DAP12 | DAP12 |
| BCA | CD28 | DAP12 | CD32 |
| BCA | CD28 | DAP12 | CD79a |
| BCA | CD28 | DAP12 | CD79b |
| BCA | CD28 | MyD88 | CD8 |
| BCA | CD28 | MyD88 | CD3ζ |
| BCA | CD28 | MyD88 | CD3δ |
| BCA | CD28 | MyD88 | CD3γ |
| BCA | CD28 | MyD88 | CD3ε |
| BCA | CD28 | MyD88 | FcγRI-γ |
| BCA | CD28 | MyD88 | FcγRIII-γ |
| BCA | CD28 | MyD88 | FcεRIβ |
| BCA | CD28 | MyD88 | FcεRIγ |
| BCA | CD28 | MyD88 | DAP10 |
| BCA | CD28 | MyD88 | DAP12 |
| BCA | CD28 | MyD88 | CD32 |
| BCA | CD28 | MyD88 | CD79a |
| BCA | CD28 | MyD88 | CD79b |
| BCA | CD28 | CD7 | CD8 |
| BCA | CD28 | CD7 | CD3ζ |
| BCA | CD28 | CD7 | CD3δ |
| BCA | CD28 | CD7 | CD3γ |
| BCA | CD28 | CD7 | CD3ε |
| BCA | CD28 | CD7 | FcγRI-γ |
| BCA | CD28 | CD7 | FcγRIII-γ |
| BCA | CD28 | CD7 | FcεRIβ |
| BCA | CD28 | CD7 | FcεRIγ |
| BCA | CD28 | CD7 | DAP10 |
| BCA | CD28 | CD7 | DAP12 |
| BCA | CD28 | CD7 | CD32 |
| BCA | CD28 | CD7 | CD79a |
| BCA | CD28 | CD7 | CD79b |
| BCA | CD28 | BTNL3 | CD8 |
| BCA | CD28 | BTNL3 | CD3ζ |
| BCA | CD28 | BTNL3 | CD3δ |

TABLE 3-continued

Third Generation CARs

| ScFv | Co-stimulatory Signal | Co-stimulatory Signal | Signal Domain |
|---|---|---|---|
| BCA | CD28 | BTNL3 | CD3γ |
| BCA | CD28 | BTNL3 | CD3ε |
| BCA | CD28 | BTNL3 | FcγRI-γ |
| BCA | CD28 | BTNL3 | FcγRIII-γ |
| BCA | CD28 | BTNL3 | FcεRIβ |
| BCA | CD28 | BTNL3 | FcεRIγ |
| BCA | CD28 | BTNL3 | DAP10 |
| BCA | CD28 | BTNL3 | DAP12 |
| BCA | CD28 | BTNL3 | CD32 |
| BCA | CD28 | BTNL3 | CD79a |
| BCA | CD28 | BTNL3 | CD79b |
| BCA | CD28 | NKG2D | CD8 |
| BCA | CD28 | NKG2D | CD3ζ |
| BCA | CD28 | NKG2D | CD3δ |
| BCA | CD28 | NKG2D | CD3γ |
| BCA | CD28 | NKG2D | CD3ε |
| BCA | CD28 | NKG2D | FcγRI-γ |
| BCA | CD28 | NKG2D | FcγRIII-γ |
| BCA | CD28 | NKG2D | FcεRIβ |
| BCA | CD28 | NKG2D | FcεRIγ |
| BCA | CD28 | NKG2D | DAP10 |
| BCA | CD28 | NKG2D | DAP12 |
| BCA | CD28 | NKG2D | CD32 |
| BCA | CD28 | NKG2D | CD79a |
| BCA | CD28 | NKG2D | CD79b |
| BCA | CD8 | CD28 | CD8 |
| BCA | CD8 | CD28 | CD3ζ |
| BCA | CD8 | CD28 | CD3δ |
| BCA | CD8 | CD28 | CD3γ |
| BCA | CD8 | CD28 | CD3ε |
| BCA | CD8 | CD28 | FcγRI-γ |
| BCA | CD8 | CD28 | FcγRIII-γ |
| BCA | CD8 | CD28 | FcεRIβ |
| BCA | CD8 | CD28 | FcεRIγ |
| BCA | CD8 | CD28 | DAP10 |
| BCA | CD8 | CD28 | DAP12 |
| BCA | CD8 | CD28 | CD32 |
| BCA | CD8 | CD28 | CD79a |
| BCA | CD8 | CD28 | CD79b |
| BCA | CD8 | CD8 | CD8 |
| BCA | CD8 | CD8 | CD3ζ |
| BCA | CD8 | CD8 | CD3δ |
| BCA | CD8 | CD8 | CD3γ |
| BCA | CD8 | CD8 | CD3ε |
| BCA | CD8 | CD8 | FcγRI-γ |
| BCA | CD8 | CD8 | FcγRIII-γ |
| BCA | CD8 | CD8 | FcεRIβ |
| BCA | CD8 | CD8 | FcεRIγ |
| BCA | CD8 | CD8 | DAP10 |
| BCA | CD8 | CD8 | DAP12 |
| BCA | CD8 | CD8 | CD32 |
| BCA | CD8 | CD8 | CD79a |
| BCA | CD8 | CD8 | CD79b |
| BCA | CD8 | CD4 | CD8 |
| BCA | CD8 | CD4 | CD3ζ |
| BCA | CD8 | CD4 | CD3δ |
| BCA | CD8 | CD4 | CD3γ |
| BCA | CD8 | CD4 | CD3ε |
| BCA | CD8 | CD4 | FcγRI-γ |
| BCA | CD8 | CD4 | FcγRIII-γ |
| BCA | CD8 | CD4 | FcεRIβ |
| BCA | CD8 | CD4 | FcεRIγ |
| BCA | CD8 | CD4 | DAP10 |
| BCA | CD8 | CD4 | DAP12 |
| BCA | CD8 | CD4 | CD32 |
| BCA | CD8 | CD4 | CD79a |
| BCA | CD8 | CD4 | CD79b |
| BCA | CD8 | b2c | CD8 |
| BCA | CD8 | b2c | CD3ζ |
| BCA | CD8 | b2c | CD3δ |
| BCA | CD8 | b2c | CD3γ |
| BCA | CD8 | b2c | CD3ε |
| BCA | CD8 | b2c | FcγRI-γ |
| BCA | CD8 | b2c | FcγRIII-γ |
| BCA | CD8 | b2c | FcεRIβ |
| BCA | CD8 | b2c | FcεRIγ |
| BCA | CD8 | b2c | DAP10 |
| BCA | CD8 | b2c | DAP12 |
| BCA | CD8 | b2c | CD32 |
| BCA | CD8 | b2c | CD79a |
| BCA | CD8 | b2c | CD79b |
| BCA | CD8 | CD137/41BB | CD8 |
| BCA | CD8 | CD137/41BB | CD3ζ |
| BCA | CD8 | CD137/41BB | CD3δ |
| BCA | CD8 | CD137/41BB | CD3γ |
| BCA | CD8 | CD137/41BB | CD3ε |
| BCA | CD8 | CD137/41BB | FcγRI-γ |
| BCA | CD8 | CD137/41BB | FcγRIII-γ |
| BCA | CD8 | CD137/41BB | FcεRIβ |
| BCA | CD8 | CD137/41BB | FcεRIγ |
| BCA | CD8 | CD137/41BB | DAP10 |
| BCA | CD8 | CD137/41BB | DAP12 |
| BCA | CD8 | CD137/41BB | CD32 |
| BCA | CD8 | CD137/41BB | CD79a |
| BCA | CD8 | CD137/41BB | CD79b |
| BCA | CD8 | ICOS | CD8 |
| BCA | CD8 | ICOS | CD3ζ |
| BCA | CD8 | ICOS | CD3δ |
| BCA | CD8 | ICOS | CD3γ |
| BCA | CD8 | ICOS | CD3ε |
| BCA | CD8 | ICOS | FcγRI-γ |
| BCA | CD8 | ICOS | FcγRIII-γ |
| BCA | CD8 | ICOS | FcεRIβ |
| BCA | CD8 | ICOS | FcεRIγ |
| BCA | CD8 | ICOS | DAP10 |
| BCA | CD8 | ICOS | DAP12 |
| BCA | CD8 | ICOS | CD32 |
| BCA | CD8 | ICOS | CD79a |
| BCA | CD8 | ICOS | CD79b |
| BCA | CD8 | CD27 | CD8 |
| BCA | CD8 | CD27 | CD3ζ |
| BCA | CD8 | CD27 | CD3δ |
| BCA | CD8 | CD27 | CD3γ |
| BCA | CD8 | CD27 | CD3ε |
| BCA | CD8 | CD27 | FcγRI-γ |
| BCA | CD8 | CD27 | FcγRIII-γ |
| BCA | CD8 | CD27 | FcεRIβ |
| BCA | CD8 | CD27 | FcεRIγ |
| BCA | CD8 | CD27 | DAP10 |
| BCA | CD8 | CD27 | DAP12 |
| BCA | CD8 | CD27 | CD32 |
| BCA | CD8 | CD27 | CD79a |
| BCA | CD8 | CD27 | CD79b |
| BCA | CD8 | CD28δ | CD8 |
| BCA | CD8 | CD28δ | CD3ζ |
| BCA | CD8 | CD28δ | CD3δ |
| BCA | CD8 | CD28δ | CD3γ |
| BCA | CD8 | CD28δ | CD3ε |
| BCA | CD8 | CD28δ | FcγRI-γ |
| BCA | CD8 | CD28δ | FcγRIII-γ |
| BCA | CD8 | CD28δ | FcεRIβ |
| BCA | CD8 | CD28δ | FcεRIγ |
| BCA | CD8 | CD28δ | DAP10 |
| BCA | CD8 | CD28δ | DAP12 |
| BCA | CD8 | CD28δ | CD32 |
| BCA | CD8 | CD28δ | CD79a |
| BCA | CD8 | CD28δ | CD79b |
| BCA | CD8 | CD80 | CD8 |
| BCA | CD8 | CD80 | CD3ζ |
| BCA | CD8 | CD80 | CD3δ |
| BCA | CD8 | CD80 | CD3γ |
| BCA | CD8 | CD80 | CD3ε |
| BCA | CD8 | CD80 | FcγRI-γ |
| BCA | CD8 | CD80 | FcγRIII-γ |
| BCA | CD8 | CD80 | FcεRIβ |
| BCA | CD8 | CD80 | FcεRIγ |
| BCA | CD8 | CD80 | DAP10 |
| BCA | CD8 | CD80 | DAP12 |
| BCA | CD8 | CD80 | CD32 |
| BCA | CD8 | CD80 | CD79a |

TABLE 3-continued

Third Generation CARs

| ScFv | Co-stimulatory Signal | Co-stimulatory Signal | Signal Domain |
|---|---|---|---|
| BCA | CD8 | CD80 | CD79b |
| BCA | CD8 | CD86 | CD8 |
| BCA | CD8 | CD86 | CD3ζ |
| BCA | CD8 | CD86 | CD3δ |
| BCA | CD8 | CD86 | CD3γ |
| BCA | CD8 | CD86 | CD3ε |
| BCA | CD8 | CD86 | FcγRI-γ |
| BCA | CD8 | CD86 | FcγRIII-γ |
| BCA | CD8 | CD86 | FcεRIβ |
| BCA | CD8 | CD86 | FcεRIγ |
| BCA | CD8 | CD86 | DAP10 |
| BCA | CD8 | CD86 | DAP12 |
| BCA | CD8 | CD86 | CD32 |
| BCA | CD8 | CD86 | CD79a |
| BCA | CD8 | CD86 | CD79b |
| BCA | CD8 | OX40 | CD8 |
| BCA | CD8 | OX40 | CD3ζ |
| BCA | CD8 | OX40 | CD3δ |
| BCA | CD8 | OX40 | CD3γ |
| BCA | CD8 | OX40 | CD3ε |
| BCA | CD8 | OX40 | FcγRI-γ |
| BCA | CD8 | OX40 | FcγRIII-γ |
| BCA | CD8 | OX40 | FcεRIβ |
| BCA | CD8 | OX40 | FcεRIγ |
| BCA | CD8 | OX40 | DAP10 |
| BCA | CD8 | OX40 | DAP12 |
| BCA | CD8 | OX40 | CD32 |
| BCA | CD8 | OX40 | CD79a |
| BCA | CD8 | OX40 | CD79b |
| BCA | CD8 | DAP10 | CD8 |
| BCA | CD8 | DAP10 | CD3ζ |
| BCA | CD8 | DAP10 | CD3δ |
| BCA | CD8 | DAP10 | CD3γ |
| BCA | CD8 | DAP10 | CD3ε |
| BCA | CD8 | DAP10 | FcγRI-γ |
| BCA | CD8 | DAP10 | FcγRIII-γ |
| BCA | CD8 | DAP10 | FcεRIβ |
| BCA | CD8 | DAP10 | FcεRIγ |
| BCA | CD8 | DAP10 | DAP10 |
| BCA | CD8 | DAP10 | DAP12 |
| BCA | CD8 | DAP10 | CD32 |
| BCA | CD8 | DAP10 | CD79a |
| BCA | CD8 | DAP10 | CD79b |
| BCA | CD8 | DAP12 | CD8 |
| BCA | CD8 | DAP12 | CD3ζ |
| BCA | CD8 | DAP12 | CD3δ |
| BCA | CD8 | DAP12 | CD3γ |
| BCA | CD8 | DAP12 | CD3ε |
| BCA | CD8 | DAP12 | FcγRI-γ |
| BCA | CD8 | DAP12 | FcγRIII-γ |
| BCA | CD8 | DAP12 | FcεRIβ |
| BCA | CD8 | DAP12 | FcεRIγ |
| BCA | CD8 | DAP12 | DAP10 |
| BCA | CD8 | DAP12 | DAP12 |
| BCA | CD8 | DAP12 | CD32 |
| BCA | CD8 | DAP12 | CD79a |
| BCA | CD8 | DAP12 | CD79b |
| BCA | CD8 | MyD88 | CD8 |
| BCA | CD8 | MyD88 | CD3ζ |
| BCA | CD8 | MyD88 | CD3δ |
| BCA | CD8 | MyD88 | CD3γ |
| BCA | CD8 | MyD88 | CD3ε |
| BCA | CD8 | MyD88 | FcγRI-γ |
| BCA | CD8 | MyD88 | FcγRIII-γ |
| BCA | CD8 | MyD88 | FcεRIβ |
| BCA | CD8 | MyD88 | FcεRIγ |
| BCA | CD8 | MyD88 | DAP10 |
| BCA | CD8 | MyD88 | DAP12 |
| BCA | CD8 | MyD88 | CD32 |
| BCA | CD8 | MyD88 | CD79a |
| BCA | CD8 | MyD88 | CD79b |
| BCA | CD8 | CD7 | CD8 |
| BCA | CD8 | CD7 | CD3ζ |
| BCA | CD8 | CD7 | CD3δ |
| BCA | CD8 | CD7 | CD3γ |
| BCA | CD8 | CD7 | CD3ε |
| BCA | CD8 | CD7 | FcγRI-γ |
| BCA | CD8 | CD7 | FcγRIII-γ |
| BCA | CD8 | CD7 | FcεRIβ |
| BCA | CD8 | CD7 | FcεRIγ |
| BCA | CD8 | CD7 | DAP10 |
| BCA | CD8 | CD7 | DAP12 |
| BCA | CD8 | CD7 | CD32 |
| BCA | CD8 | CD7 | CD79a |
| BCA | CD8 | CD7 | CD79b |
| BCA | CD8 | BTNL3 | CD8 |
| BCA | CD8 | BTNL3 | CD3ζ |
| BCA | CD8 | BTNL3 | CD3δ |
| BCA | CD8 | BTNL3 | CD3γ |
| BCA | CD8 | BTNL3 | CD3ε |
| BCA | CD8 | BTNL3 | FcγRI-γ |
| BCA | CD8 | BTNL3 | FcγRIII-γ |
| BCA | CD8 | BTNL3 | FcεRIβ |
| BCA | CD8 | BTNL3 | FcεRIγ |
| BCA | CD8 | BTNL3 | DAP10 |
| BCA | CD8 | BTNL3 | DAP12 |
| BCA | CD8 | BTNL3 | CD32 |
| BCA | CD8 | BTNL3 | CD79a |
| BCA | CD8 | BTNL3 | CD79b |
| BCA | CD8 | NKG2D | CD8 |
| BCA | CD8 | NKG2D | CD3ζ |
| BCA | CD8 | NKG2D | CD3δ |
| BCA | CD8 | NKG2D | CD3γ |
| BCA | CD8 | NKG2D | CD3ε |
| BCA | CD8 | NKG2D | FcγRI-γ |
| BCA | CD8 | NKG2D | FcγRIII-γ |
| BCA | CD8 | NKG2D | FcεRIβ |
| BCA | CD8 | NKG2D | FcεRIγ |
| BCA | CD8 | NKG2D | DAP10 |
| BCA | CD8 | NKG2D | DAP12 |
| BCA | CD8 | NKG2D | CD32 |
| BCA | CD8 | NKG2D | CD79a |
| BCA | CD8 | NKG2D | CD79b |
| BCA | CD4 | CD28 | CD8 |
| BCA | CD4 | CD28 | CD3ζ |
| BCA | CD4 | CD28 | CD3δ |
| BCA | CD4 | CD28 | CD3γ |
| BCA | CD4 | CD28 | CD3ε |
| BCA | CD4 | CD28 | FcγRI-γ |
| BCA | CD4 | CD28 | FcγRIII-γ |
| BCA | CD4 | CD28 | FcεRIβ |
| BCA | CD4 | CD28 | FcεRIγ |
| BCA | CD4 | CD28 | DAP10 |
| BCA | CD4 | CD28 | DAP12 |
| BCA | CD4 | CD28 | CD32 |
| BCA | CD4 | CD28 | CD79a |
| BCA | CD4 | CD28 | CD79b |
| BCA | CD4 | CD8 | CD8 |
| BCA | CD4 | CD8 | CD3ζ |
| BCA | CD4 | CD8 | CD3δ |
| BCA | CD4 | CD8 | CD3γ |
| BCA | CD4 | CD8 | CD3ε |
| BCA | CD4 | CD8 | FcγRI-γ |
| BCA | CD4 | CD8 | FcγRIII-γ |
| BCA | CD4 | CD8 | FcεRIβ |
| BCA | CD4 | CD8 | FcεRIγ |
| BCA | CD4 | CD8 | DAP10 |
| BCA | CD4 | CD8 | DAP12 |
| BCA | CD4 | CD8 | CD32 |
| BCA | CD4 | CD8 | CD79a |
| BCA | CD4 | CD8 | CD79b |
| BCA | CD4 | CD4 | CD8 |
| BCA | CD4 | CD4 | CD3ζ |
| BCA | CD4 | CD4 | CD3δ |
| BCA | CD4 | CD4 | CD3γ |
| BCA | CD4 | CD4 | CD3ε |
| BCA | CD4 | CD4 | FcγRI-γ |
| BCA | CD4 | CD4 | FcγRIII-γ |
| BCA | CD4 | CD4 | FcεRIβ |
| BCA | CD4 | CD4 | FcεRIγ |

TABLE 3-continued

Third Generation CARs

| ScFv | Co-stimulatory Signal | Co-stimulatory Signal | Signal Domain |
|---|---|---|---|
| BCA | CD4 | CD4 | DAP10 |
| BCA | CD4 | CD4 | DAP12 |
| BCA | CD4 | CD4 | CD32 |
| BCA | CD4 | CD4 | CD79a |
| BCA | CD4 | CD4 | CD79b |
| BCA | CD4 | b2c | CD8 |
| BCA | CD4 | b2c | CD3ζ |
| BCA | CD4 | b2c | CD3δ |
| BCA | CD4 | b2c | CD3γ |
| BCA | CD4 | b2c | CD3ε |
| BCA | CD4 | b2c | FcγRI-γ |
| BCA | CD4 | b2c | FcγRIII-γ |
| BCA | CD4 | b2c | FcεRIβ |
| BCA | CD4 | b2c | FcεRIγ |
| BCA | CD4 | b2c | DAP10 |
| BCA | CD4 | b2c | DAP12 |
| BCA | CD4 | b2c | CD32 |
| BCA | CD4 | b2c | CD79a |
| BCA | CD4 | b2c | CD79b |
| BCA | CD4 | CD137/41BB | CD8 |
| BCA | CD4 | CD137/41BB | CD3ζ |
| BCA | CD4 | CD137/41BB | CD3δ |
| BCA | CD4 | CD137/41BB | CD3γ |
| BCA | CD4 | CD137/41BB | CD3ε |
| BCA | CD4 | CD137/41BB | FcγRI-γ |
| BCA | CD4 | CD137/41BB | FcγRIII-γ |
| BCA | CD4 | CD137/41BB | FcεRIβ |
| BCA | CD4 | CD137/41BB | FcεRIγ |
| BCA | CD4 | CD137/41BB | DAP10 |
| BCA | CD4 | CD137/41BB | DAP12 |
| BCA | CD4 | CD137/41BB | CD32 |
| BCA | CD4 | CD137/41BB | CD79a |
| BCA | CD4 | CD137/41BB | CD79b |
| BCA | CD4 | ICOS | CD8 |
| BCA | CD4 | ICOS | CD3ζ |
| BCA | CD4 | ICOS | CD3δ |
| BCA | CD4 | ICOS | CD3γ |
| BCA | CD4 | ICOS | CD3ε |
| BCA | CD4 | ICOS | FcγRI-γ |
| BCA | CD4 | ICOS | FcγRIII-γ |
| BCA | CD4 | ICOS | FcεRIβ |
| BCA | CD4 | ICOS | FcεRIγ |
| BCA | CD4 | ICOS | DAP10 |
| BCA | CD4 | ICOS | DAP12 |
| BCA | CD4 | ICOS | CD32 |
| BCA | CD4 | ICOS | CD79a |
| BCA | CD4 | ICOS | CD79b |
| BCA | CD4 | CD27 | CD8 |
| BCA | CD4 | CD27 | CD3ζ |
| BCA | CD4 | CD27 | CD3δ |
| BCA | CD4 | CD27 | CD3γ |
| BCA | CD4 | CD27 | CD3ε |
| BCA | CD4 | CD27 | FcγRI-γ |
| BCA | CD4 | CD27 | FcγRIII-γ |
| BCA | CD4 | CD27 | FcεRIβ |
| BCA | CD4 | CD27 | FcεRIγ |
| BCA | CD4 | CD27 | DAP10 |
| BCA | CD4 | CD27 | DAP12 |
| BCA | CD4 | CD27 | CD32 |
| BCA | CD4 | CD27 | CD79a |
| BCA | CD4 | CD27 | CD79b |
| BCA | CD4 | CD28δ | CD8 |
| BCA | CD4 | CD28δ | CD3ζ |
| BCA | CD4 | CD28δ | CD3δ |
| BCA | CD4 | CD28δ | CD3γ |
| BCA | CD4 | CD28δ | CD3ε |
| BCA | CD4 | CD28δ | FcγRI-γ |
| BCA | CD4 | CD28δ | FcγRIII-γ |
| BCA | CD4 | CD28δ | FcεRIβ |
| BCA | CD4 | CD28δ | FcεRIγ |
| BCA | CD4 | CD28δ | DAP10 |
| BCA | CD4 | CD28δ | DAP12 |
| BCA | CD4 | CD28δ | CD32 |
| BCA | CD4 | CD28δ | CD79a |
| BCA | CD4 | CD28δ | CD79b |
| BCA | CD4 | CD80 | CD8 |
| BCA | CD4 | CD80 | CD3ζ |
| BCA | CD4 | CD80 | CD3δ |
| BCA | CD4 | CD80 | CD3γ |
| BCA | CD4 | CD80 | CD3ε |
| BCA | CD4 | CD80 | FcγRI-γ |
| BCA | CD4 | CD80 | FcγRIII-γ |
| BCA | CD4 | CD80 | FcεRIβ |
| BCA | CD4 | CD80 | FcεRIγ |
| BCA | CD4 | CD80 | DAP10 |
| BCA | CD4 | CD80 | DAP12 |
| BCA | CD4 | CD80 | CD32 |
| BCA | CD4 | CD80 | CD79a |
| BCA | CD4 | CD80 | CD79b |
| BCA | CD4 | CD86 | CD8 |
| BCA | CD4 | CD86 | CD3ζ |
| BCA | CD4 | CD86 | CD3δ |
| BCA | CD4 | CD86 | CD3γ |
| BCA | CD4 | CD86 | CD3ε |
| BCA | CD4 | CD86 | FcγRI-γ |
| BCA | CD4 | CD86 | FcγRIII-γ |
| BCA | CD4 | CD86 | FcεRIβ |
| BCA | CD4 | CD86 | FcεRIγ |
| BCA | CD4 | CD86 | DAP10 |
| BCA | CD4 | CD86 | DAP12 |
| BCA | CD4 | CD86 | CD32 |
| BCA | CD4 | CD86 | CD79a |
| BCA | CD4 | CD86 | CD79b |
| BCA | CD4 | OX40 | CD8 |
| BCA | CD4 | OX40 | CD3ζ |
| BCA | CD4 | OX40 | CD3δ |
| BCA | CD4 | OX40 | CD3γ |
| BCA | CD4 | OX40 | CD3ε |
| BCA | CD4 | OX40 | FcγRI-γ |
| BCA | CD4 | OX40 | FcγRIII-γ |
| BCA | CD4 | OX40 | FcεRIβ |
| BCA | CD4 | OX40 | FcεRIγ |
| BCA | CD4 | OX40 | DAP10 |
| BCA | CD4 | OX40 | DAP12 |
| BCA | CD4 | OX40 | CD32 |
| BCA | CD4 | OX40 | CD79a |
| BCA | CD4 | OX40 | CD79b |
| BCA | CD4 | DAP10 | CD8 |
| BCA | CD4 | DAP10 | CD3ζ |
| BCA | CD4 | DAP10 | CD3δ |
| BCA | CD4 | DAP10 | CD3γ |
| BCA | CD4 | DAP10 | CD3ε |
| BCA | CD4 | DAP10 | FcγRI-γ |
| BCA | CD4 | DAP10 | FcγRIII-γ |
| BCA | CD4 | DAP10 | FcεRIβ |
| BCA | CD4 | DAP10 | FcεRIγ |
| BCA | CD4 | DAP10 | DAP10 |
| BCA | CD4 | DAP10 | DAP12 |
| BCA | CD4 | DAP10 | CD32 |
| BCA | CD4 | DAP10 | CD79a |
| BCA | CD4 | DAP10 | CD79b |
| BCA | CD4 | DAP12 | CD8 |
| BCA | CD4 | DAP12 | CD3ζ |
| BCA | CD4 | DAP12 | CD3δ |
| BCA | CD4 | DAP12 | CD3γ |
| BCA | CD4 | DAP12 | CD3ε |
| BCA | CD4 | DAP12 | FcγRI-γ |
| BCA | CD4 | DAP12 | FcγRIII-γ |
| BCA | CD4 | DAP12 | FcεRIβ |
| BCA | CD4 | DAP12 | FcεRIγ |
| BCA | CD4 | DAP12 | DAP10 |
| BCA | CD4 | DAP12 | DAP12 |
| BCA | CD4 | DAP12 | CD32 |
| BCA | CD4 | DAP12 | CD79a |
| BCA | CD4 | DAP12 | CD79b |
| BCA | CD4 | MyD88 | CD8 |
| BCA | CD4 | MyD88 | CD3ζ |
| BCA | CD4 | MyD88 | CD3δ |
| BCA | CD4 | MyD88 | CD3γ |
| BCA | CD4 | MyD88 | CD3ε |

TABLE 3-continued

Third Generation CARs

| ScFv | Co-stimulatory Signal | Co-stimulatory Signal | Signal Domain |
|---|---|---|---|
| BCA | CD4 | MyD88 | FcγRI-γ |
| BCA | CD4 | MyD88 | FcγRIII-γ |
| BCA | CD4 | MyD88 | FcεRIβ |
| BCA | CD4 | MyD88 | FcεRIγ |
| BCA | CD4 | MyD88 | DAP10 |
| BCA | CD4 | MyD88 | DAP12 |
| BCA | CD4 | MyD88 | CD32 |
| BCA | CD4 | MyD88 | CD79a |
| BCA | CD4 | MyD88 | CD79b |
| BCA | CD4 | CD7 | CD8 |
| BCA | CD4 | CD7 | CD3ζ |
| BCA | CD4 | CD7 | CD3δ |
| BCA | CD4 | CD7 | CD3γ |
| BCA | CD4 | CD7 | CD3ε |
| BCA | CD4 | CD7 | FcγRI-γ |
| BCA | CD4 | CD7 | FcγRIII-γ |
| BCA | CD4 | CD7 | FcεRIβ |
| BCA | CD4 | CD7 | FcεRIγ |
| BCA | CD4 | CD7 | DAP10 |
| BCA | CD4 | CD7 | DAP12 |
| BCA | CD4 | CD7 | CD32 |
| BCA | CD4 | CD7 | CD79a |
| BCA | CD4 | CD7 | CD79b |
| BCA | CD4 | BTNL3 | CD8 |
| BCA | CD4 | BTNL3 | CD3ζ |
| BCA | CD4 | BTNL3 | CD3δ |
| BCA | CD4 | BTNL3 | CD3γ |
| BCA | CD4 | BTNL3 | CD3ε |
| BCA | CD4 | BTNL3 | FcγRI-γ |
| BCA | CD4 | BTNL3 | FcγRIII-γ |
| BCA | CD4 | BTNL3 | FcεRIβ |
| BCA | CD4 | BTNL3 | FcεRIγ |
| BCA | CD4 | BTNL3 | DAP10 |
| BCA | CD4 | BTNL3 | DAP12 |
| BCA | CD4 | BTNL3 | CD32 |
| BCA | CD4 | BTNL3 | CD79a |
| BCA | CD4 | BTNL3 | CD79b |
| BCA | CD4 | NKG2D | CD8 |
| BCA | CD4 | NKG2D | CD3ζ |
| BCA | CD4 | NKG2D | CD3δ |
| BCA | CD4 | NKG2D | CD3γ |
| BCA | CD4 | NKG2D | CD3ε |
| BCA | CD4 | NKG2D | FcγRI-γ |
| BCA | CD4 | NKG2D | FcγRIII-γ |
| BCA | CD4 | NKG2D | FcεRIβ |
| BCA | CD4 | NKG2D | FcεRIγ |
| BCA | CD4 | NKG2D | DAP10 |
| BCA | CD4 | NKG2D | DAP12 |
| BCA | CD4 | NKG2D | CD32 |
| BCA | CD4 | NKG2D | CD79a |
| BCA | CD4 | NKG2D | CD79b |
| BCA | b2c | CD28 | CD8 |
| BCA | b2c | CD28 | CD3ζ |
| BCA | b2c | CD28 | CD3δ |
| BCA | b2c | CD28 | CD3γ |
| BCA | b2c | CD28 | CD3ε |
| BCA | b2c | CD28 | FcγRI-γ |
| BCA | b2c | CD28 | FcγRIII-γ |
| BCA | b2c | CD28 | FcεRIβ |
| BCA | b2c | CD28 | FcεRIγ |
| BCA | b2c | CD28 | DAP10 |
| BCA | b2c | CD28 | DAP12 |
| BCA | b2c | CD28 | CD32 |
| BCA | b2c | CD28 | CD79a |
| BCA | b2c | CD28 | CD79b |
| BCA | b2c | CD8 | CD8 |
| BCA | b2c | CD8 | CD3ζ |
| BCA | b2c | CD8 | CD3δ |
| BCA | b2c | CD8 | CD3γ |
| BCA | b2c | CD8 | CD3ε |
| BCA | b2c | CD8 | FcγRI-γ |
| BCA | b2c | CD8 | FcγRIII-γ |
| BCA | b2c | CD8 | FcεRIβ |
| BCA | b2c | CD8 | FcεRIγ |
| BCA | b2c | CD8 | DAP10 |
| BCA | b2c | CD8 | DAP12 |
| BCA | b2c | CD8 | CD32 |
| BCA | b2c | CD8 | CD79a |
| BCA | b2c | CD8 | CD79b |
| BCA | b2c | CD4 | CD8 |
| BCA | b2c | CD4 | CD3ζ |
| BCA | b2c | CD4 | CD3δ |
| BCA | b2c | CD4 | CD3γ |
| BCA | b2c | CD4 | CD3ε |
| BCA | b2c | CD4 | FcγRI-γ |
| BCA | b2c | CD4 | FcγRIII-γ |
| BCA | b2c | CD4 | FcεRIβ |
| BCA | b2c | CD4 | FcεRIγ |
| BCA | b2c | CD4 | DAP10 |
| BCA | b2c | CD4 | DAP12 |
| BCA | b2c | CD4 | CD32 |
| BCA | b2c | CD4 | CD79a |
| BCA | b2c | CD4 | CD79b |
| BCA | b2c | b2c | CD8 |
| BCA | b2c | b2c | CD3ζ |
| BCA | b2c | b2c | CD3δ |
| BCA | b2c | b2c | CD3γ |
| BCA | b2c | b2c | CD3ε |
| BCA | b2c | b2c | FcγRI-γ |
| BCA | b2c | b2c | FcγRIII-γ |
| BCA | b2c | b2c | FcεRIβ |
| BCA | b2c | b2c | FcεRIγ |
| BCA | b2c | b2c | DAP10 |
| BCA | b2c | b2c | DAP12 |
| BCA | b2c | b2c | CD32 |
| BCA | b2c | b2c | CD79a |
| BCA | b2c | b2c | CD79b |
| BCA | b2c | CD137/41BB | CD8 |
| BCA | b2c | CD137/41BB | CD3ζ |
| BCA | b2c | CD137/41BB | CD3δ |
| BCA | b2c | CD137/41BB | CD3γ |
| BCA | b2c | CD137/41BB | CD3ε |
| BCA | b2c | CD137/41BB | FcγRI-γ |
| BCA | b2c | CD137/41BB | FcγRIII-γ |
| BCA | b2c | CD137/41BB | FcεRIβ |
| BCA | b2c | CD137/41BB | FcεRIγ |
| BCA | b2c | CD137/41BB | DAP10 |
| BCA | b2c | CD137/41BB | DAP12 |
| BCA | b2c | CD137/41BB | CD32 |
| BCA | b2c | CD137/41BB | CD79a |
| BCA | b2c | CD137/41BB | CD79b |
| BCA | b2c | ICOS | CD8 |
| BCA | b2c | ICOS | CD3ζ |
| BCA | b2c | ICOS | CD3δ |
| BCA | b2c | ICOS | CD3γ |
| BCA | b2c | ICOS | CD3ε |
| BCA | b2c | ICOS | FcγRI-γ |
| BCA | b2c | ICOS | FcγRIII-γ |
| BCA | b2c | ICOS | FcεRIβ |
| BCA | b2c | ICOS | FcεRIγ |
| BCA | b2c | ICOS | DAP10 |
| BCA | b2c | ICOS | DAP12 |
| BCA | b2c | ICOS | CD32 |
| BCA | b2c | ICOS | CD79a |
| BCA | b2c | ICOS | CD79b |
| BCA | b2c | CD27 | CD8 |
| BCA | b2c | CD27 | CD3ζ |
| BCA | b2c | CD27 | CD3δ |
| BCA | b2c | CD27 | CD3γ |
| BCA | b2c | CD27 | CD3ε |
| BCA | b2c | CD27 | FcγRI-γ |
| BCA | b2c | CD27 | FcγRIII-γ |
| BCA | b2c | CD27 | FcεRIβ |
| BCA | b2c | CD27 | FcεRIγ |
| BCA | b2c | CD27 | DAP10 |
| BCA | b2c | CD27 | DAP12 |
| BCA | b2c | CD27 | CD32 |
| BCA | b2c | CD27 | CD79a |
| BCA | b2c | CD27 | CD79b |
| BCA | b2c | CD280 | CD8 |

TABLE 3-continued

Third Generation CARs

| ScFv | Co-stimulatory Signal | Co-stimulatory Signal | Signal Domain |
|---|---|---|---|
| BCA | b2c | CD28δ | CD3ζ |
| BCA | b2c | CD28δ | CD3δ |
| BCA | b2c | CD28δ | CD3γ |
| BCA | b2c | CD28δ | CD3ε |
| BCA | b2c | CD28δ | FcγRI-γ |
| BCA | b2c | CD28δ | FcγRIII-γ |
| BCA | b2c | CD28δ | FcεRIβ |
| BCA | b2c | CD28δ | FcεRIγ |
| BCA | b2c | CD28δ | DAP10 |
| BCA | b2c | CD28δ | DAP12 |
| BCA | b2c | CD28δ | CD32 |
| BCA | b2c | CD28δ | CD79a |
| BCA | b2c | CD28δ | CD79b |
| BCA | b2c | CD80 | CD8 |
| BCA | b2c | CD80 | CD3ζ |
| BCA | b2c | CD80 | CD3δ |
| BCA | b2c | CD80 | CD3γ |
| BCA | b2c | CD80 | CD3ε |
| BCA | b2c | CD80 | FcγRI-γ |
| BCA | b2c | CD80 | FcγRIII-γ |
| BCA | b2c | CD80 | FcεRIβ |
| BCA | b2c | CD80 | FcεRIγ |
| BCA | b2c | CD80 | DAP10 |
| BCA | b2c | CD80 | DAP12 |
| BCA | b2c | CD80 | CD32 |
| BCA | b2c | CD80 | CD79a |
| BCA | b2c | CD80 | CD79b |
| BCA | b2c | CD86 | CD8 |
| BCA | b2c | CD86 | CD3ζ |
| BCA | b2c | CD86 | CD3δ |
| BCA | b2c | CD86 | CD3γ |
| BCA | b2c | CD86 | CD3ε |
| BCA | b2c | CD86 | FcγRI-γ |
| BCA | b2c | CD86 | FcγRIII-γ |
| BCA | b2c | CD86 | FcεRIβ |
| BCA | b2c | CD86 | FcεRIγ |
| BCA | b2c | CD86 | DAP10 |
| BCA | b2c | CD86 | DAP12 |
| BCA | b2c | CD86 | CD32 |
| BCA | b2c | CD86 | CD79a |
| BCA | b2c | CD86 | CD79b |
| BCA | b2c | OX40 | CD8 |
| BCA | b2c | OX40 | CD3ζ |
| BCA | b2c | OX40 | CD3δ |
| BCA | b2c | OX40 | CD3γ |
| BCA | b2c | OX40 | CD3ε |
| BCA | b2c | OX40 | FcγRI-γ |
| BCA | b2c | OX40 | FcγRIII-γ |
| BCA | b2c | OX40 | FcεRIβ |
| BCA | b2c | OX40 | FcεRIγ |
| BCA | b2c | OX40 | DAP10 |
| BCA | b2c | OX40 | DAP12 |
| BCA | b2c | OX40 | CD32 |
| BCA | b2c | OX40 | CD79a |
| BCA | b2c | OX40 | CD79b |
| BCA | b2c | DAP10 | CD8 |
| BCA | b2c | DAP10 | CD3ζ |
| BCA | b2c | DAP10 | CD3δ |
| BCA | b2c | DAP10 | CD3γ |
| BCA | b2c | DAP10 | CD3ε |
| BCA | b2c | DAP10 | FcγRI-γ |
| BCA | b2c | DAP10 | FcγRIII-γ |
| BCA | b2c | DAP10 | FcεRIβ |
| BCA | b2c | DAP10 | FcεRIγ |
| BCA | b2c | DAP10 | DAP10 |
| BCA | b2c | DAP10 | DAP12 |
| BCA | b2c | DAP10 | CD32 |
| BCA | b2c | DAP10 | CD79a |
| BCA | b2c | DAP10 | CD79b |
| BCA | b2c | DAP12 | CD8 |
| BCA | b2c | DAP12 | CD3ζ |
| BCA | b2c | DAP12 | CD3δ |
| BCA | b2c | DAP12 | CD3γ |
| BCA | b2c | DAP12 | CD3ε |
| BCA | b2c | DAP12 | FcγRI-γ |
| BCA | b2c | DAP12 | FcγRIII-γ |
| BCA | b2c | DAP12 | FcεRIβ |
| BCA | b2c | DAP12 | FcεRIγ |
| BCA | b2c | DAP12 | DAP10 |
| BCA | b2c | DAP12 | DAP12 |
| BCA | b2c | DAP12 | CD32 |
| BCA | b2c | DAP12 | CD79a |
| BCA | b2c | DAP12 | CD79b |
| BCA | b2c | MyD88 | CD8 |
| BCA | b2c | MyD88 | CD3ζ |
| BCA | b2c | MyD88 | CD3δ |
| BCA | b2c | MyD88 | CD3γ |
| BCA | b2c | MyD88 | CD3ε |
| BCA | b2c | MyD88 | FcγRI-γ |
| BCA | b2c | MyD88 | FcγRIII-γ |
| BCA | b2c | MyD88 | FcεRIβ |
| BCA | b2c | MyD88 | FcεRIγ |
| BCA | b2c | MyD88 | DAP10 |
| BCA | b2c | MyD88 | DAP12 |
| BCA | b2c | MyD88 | CD32 |
| BCA | b2c | MyD88 | CD79a |
| BCA | b2c | MyD88 | CD79b |
| BCA | b2c | CD7 | CD8 |
| BCA | b2c | CD7 | CD3ζ |
| BCA | b2c | CD7 | CD3δ |
| BCA | b2c | CD7 | CD3γ |
| BCA | b2c | CD7 | CD3ε |
| BCA | b2c | CD7 | FcγRI-γ |
| BCA | b2c | CD7 | FcγRIII-γ |
| BCA | b2c | CD7 | FcεRIβ |
| BCA | b2c | CD7 | FcεRIγ |
| BCA | b2c | CD7 | DAP10 |
| BCA | b2c | CD7 | DAP12 |
| BCA | b2c | CD7 | CD32 |
| BCA | b2c | CD7 | CD79a |
| BCA | b2c | CD7 | CD79b |
| BCA | b2c | BTNL3 | CD8 |
| BCA | b2c | BTNL3 | CD3ζ |
| BCA | b2c | BTNL3 | CD3δ |
| BCA | b2c | BTNL3 | CD3γ |
| BCA | b2c | BTNL3 | CD3ε |
| BCA | b2c | BTNL3 | FcγRI-γ |
| BCA | b2c | BTNL3 | FcγRIII-γ |
| BCA | b2c | BTNL3 | FcεRIβ |
| BCA | b2c | BTNL3 | FcεRIγ |
| BCA | b2c | BTNL3 | DAP10 |
| BCA | b2c | BTNL3 | DAP12 |
| BCA | b2c | BTNL3 | CD32 |
| BCA | b2c | BTNL3 | CD79a |
| BCA | b2c | BTNL3 | CD79b |
| BCA | b2c | NKG2D | CD8 |
| BCA | b2c | NKG2D | CD3ζ |
| BCA | b2c | NKG2D | CD3δ |
| BCA | b2c | NKG2D | CD3γ |
| BCA | b2c | NKG2D | CD3ε |
| BCA | b2c | NKG2D | FcγRI-γ |
| BCA | b2c | NKG2D | FcγRIII-γ |
| BCA | b2c | NKG2D | FcεRIβ |
| BCA | b2c | NKG2D | FcεRIγ |
| BCA | b2c | NKG2D | DAP10 |
| BCA | b2c | NKG2D | DAP12 |
| BCA | b2c | NKG2D | CD32 |
| BCA | b2c | NKG2D | CD79a |
| BCA | b2c | NKG2D | CD79b |
| BCA | CD137/41BB | CD28 | CD8 |
| BCA | CD137/41BB | CD28 | CD3ζ |
| BCA | CD137/41BB | CD28 | CD3δ |
| BCA | CD137/41BB | CD28 | CD3γ |
| BCA | CD137/41BB | CD28 | CD3ε |
| BCA | CD137/41BB | CD28 | FcγRI-γ |
| BCA | CD137/41BB | CD28 | FcγRIII-γ |
| BCA | CD137/41BB | CD28 | FcεRIβ |
| BCA | CD137/41BB | CD28 | FcεRIγ |
| BCA | CD137/41BB | CD28 | DAP10 |
| BCA | CD137/41BB | CD28 | DAP12 |

TABLE 3-continued

Third Generation CARs

| ScFv | Co-stimulatory Signal | Co-stimulatory Signal | Signal Domain |
|---|---|---|---|
| BCA | CD137/41BB | CD28 | CD79a |
| BCA | CD137/41BB | CD28 | CD79b |
| BCA | CD137/41BB | CD8 | CD8 |
| BCA | CD137/41BB | CD8 | CD3ζ |
| BCA | CD137/41BB | CD8 | CD3δ |
| BCA | CD137/41BB | CD8 | CD3γ |
| BCA | CD137/41BB | CD8 | CD3ε |
| BCA | CD137/41BB | CD8 | FcγRI-γ |
| BCA | CD137/41BB | CD8 | FcγRIII-γ |
| BCA | CD137/41BB | CD8 | FcεRIβ |
| BCA | CD137/41BB | CD8 | FcεRIγ |
| BCA | CD137/41BB | CD8 | DAP10 |
| BCA | CD137/41BB | CD8 | DAP12 |
| BCA | CD137/41BB | CD8 | CD32 |
| BCA | CD137/41BB | CD8 | CD79a |
| BCA | CD137/41BB | CD8 | CD79b |
| BCA | CD137/41BB | CD4 | CD8 |
| BCA | CD137/41BB | CD4 | CD3ζ |
| BCA | CD137/41BB | CD4 | CD3δ |
| BCA | CD137/41BB | CD4 | CD3γ |
| BCA | CD137/41BB | CD4 | CD3ε |
| BCA | CD137/41BB | CD4 | FcγRI-γ |
| BCA | CD137/41BB | CD4 | FcγRIII-γ |
| BCA | CD137/41BB | CD4 | FcεRIβ |
| BCA | CD137/41BB | CD4 | FcεRIγ |
| BCA | CD137/41BB | CD4 | DAP10 |
| BCA | CD137/41BB | CD4 | DAP12 |
| BCA | CD137/41BB | CD4 | CD32 |
| BCA | CD137/41BB | CD4 | CD79a |
| BCA | CD137/41BB | CD4 | CD79b |
| BCA | CD137/41BB | b2c | CD8 |
| BCA | CD137/41BB | b2c | CD3ζ |
| BCA | CD137/41BB | b2c | CD3δ |
| BCA | CD137/41BB | b2c | CD3γ |
| BCA | CD137/41BB | b2c | CD3ε |
| BCA | CD137/41BB | b2c | FcγRI-γ |
| BCA | CD137/41BB | b2c | FcγRIII-γ |
| BCA | CD137/41BB | b2c | FcεRIβ |
| BCA | CD137/41BB | b2c | FcεRIγ |
| BCA | CD137/41BB | b2c | DAP10 |
| BCA | CD137/41BB | b2c | DAP12 |
| BCA | CD137/41BB | b2c | CD32 |
| BCA | CD137/41BB | b2c | CD79a |
| BCA | CD137/41BB | b2c | CD79b |
| BCA | CD137/41BB | CD137/41BB | CD8 |
| BCA | CD137/41BB | CD137/41BB | CD3ζ |
| BCA | CD137/41BB | CD137/41BB | CD3δ |
| BCA | CD137/41BB | CD137/41BB | CD3γ |
| BCA | CD137/41BB | CD137/41BB | CD3ε |
| BCA | CD137/41BB | CD137/41BB | FcγRI-γ |
| BCA | CD137/41BB | CD137/41BB | FcγRIII-γ |
| BCA | CD137/41BB | CD137/41BB | FcεRIβ |
| BCA | CD137/41BB | CD137/41BB | FcεRIγ |
| BCA | CD137/41BB | CD137/41BB | DAP10 |
| BCA | CD137/41BB | CD137/41BB | DAP12 |
| BCA | CD137/41BB | CD137/41BB | CD32 |
| BCA | CD137/41BB | CD137/41BB | CD79a |
| BCA | CD137/41BB | CD137/41BB | CD79b |
| BCA | CD137/41BB | ICOS | CD8 |
| BCA | CD137/41BB | ICOS | CD3ζ |
| BCA | CD137/41BB | ICOS | CD3δ |
| BCA | CD137/41BB | ICOS | CD3γ |
| BCA | CD137/41BB | ICOS | CD3ε |
| BCA | CD137/41BB | ICOS | FcγRI-γ |
| BCA | CD137/41BB | ICOS | FcγRIII-γ |
| BCA | CD137/41BB | ICOS | FcεRIβ |
| BCA | CD137/41BB | ICOS | FcεRIγ |
| BCA | CD137/41BB | ICOS | DAP10 |
| BCA | CD137/41BB | ICOS | DAP12 |
| BCA | CD137/41BB | ICOS | CD32 |
| BCA | CD137/41BB | ICOS | CD79a |
| BCA | CD137/41BB | ICOS | CD79b |
| BCA | CD137/41BB | CD27 | CD8 |
| BCA | CD137/41BB | CD27 | CD3ζ |
| BCA | CD137/41BB | CD27 | CD3δ |
| BCA | CD137/41BB | CD27 | CD3γ |
| BCA | CD137/41BB | CD27 | CD3ε |
| BCA | CD137/41BB | CD27 | FcγRI-γ |
| BCA | CD137/41BB | CD27 | FcγRIII-γ |
| BCA | CD137/41BB | CD27 | FcεRIβ |
| BCA | CD137/41BB | CD27 | FcεRIγ |
| BCA | CD137/41BB | CD27 | DAP10 |
| BCA | CD137/41BB | CD27 | DAP12 |
| BCA | CD137/41BB | CD27 | CD32 |
| BCA | CD137/41BB | CD27 | CD79a |
| BCA | CD137/41BB | CD27 | CD79b |
| BCA | CD137/41BB | CD28δ | CD8 |
| BCA | CD137/41BB | CD28δ | CD3ζ |
| BCA | CD137/41BB | CD28δ | CD3δ |
| BCA | CD137/41BB | CD28δ | CD3γ |
| BCA | CD137/41BB | CD28δ | CD3ε |
| BCA | CD137/41BB | CD28δ | FcγRI-γ |
| BCA | CD137/41BB | CD28δ | FcγRIII-γ |
| BCA | CD137/41BB | CD28δ | FcεRIβ |
| BCA | CD137/41BB | CD28δ | FcεRIγ |
| BCA | CD137/41BB | CD28δ | DAP10 |
| BCA | CD137/41BB | CD28δ | DAP12 |
| BCA | CD137/41BB | CD28δ | CD32 |
| BCA | CD137/41BB | CD28δ | CD79a |
| BCA | CD137/41BB | CD28δ | CD79b |
| BCA | CD137/41BB | CD80 | CD8 |
| BCA | CD137/41BB | CD80 | CD3ζ |
| BCA | CD137/41BB | CD80 | CD3δ |
| BCA | CD137/41BB | CD80 | CD3γ |
| BCA | CD137/41BB | CD80 | CD3ε |
| BCA | CD137/41BB | CD80 | FcγRI-γ |
| BCA | CD137/41BB | CD80 | FcγRIII-γ |
| BCA | CD137/41BB | CD80 | FcεRIβ |
| BCA | CD137/41BB | CD80 | FcεRIγ |
| BCA | CD137/41BB | CD80 | DAP10 |
| BCA | CD137/41BB | CD80 | DAP12 |
| BCA | CD137/41BB | CD80 | CD32 |
| BCA | CD137/41BB | CD80 | CD79a |
| BCA | CD137/41BB | CD80 | CD79b |
| BCA | CD137/41BB | CD86 | CD8 |
| BCA | CD137/41BB | CD86 | CD3ζ |
| BCA | CD137/41BB | CD86 | CD3δ |
| BCA | CD137/41BB | CD86 | CD3γ |
| BCA | CD137/41BB | CD86 | CD3ε |
| BCA | CD137/41BB | CD86 | FcγRI-γ |
| BCA | CD137/41BB | CD86 | FcγRIII-γ |
| BCA | CD137/41BB | CD86 | FcεRIβ |
| BCA | CD137/41BB | CD86 | FcεRIγ |
| BCA | CD137/41BB | CD86 | DAP10 |
| BCA | CD137/41BB | CD86 | DAP12 |
| BCA | CD137/41BB | CD86 | CD32 |
| BCA | CD137/41BB | CD86 | CD79a |
| BCA | CD137/41BB | CD86 | CD79b |
| BCA | CD137/41BB | OX40 | CD8 |
| BCA | CD137/41BB | OX40 | CD3ζ |
| BCA | CD137/41BB | OX40 | CD3δ |
| BCA | CD137/41BB | OX40 | CD3γ |
| BCA | CD137/41BB | OX40 | CD3ε |
| BCA | CD137/41BB | OX40 | FcγRI-γ |
| BCA | CD137/41BB | OX40 | FcγRIII-γ |
| BCA | CD137/41BB | OX40 | FcεRIβ |
| BCA | CD137/41BB | OX40 | FcεRIγ |
| BCA | CD137/41BB | OX40 | DAP10 |
| BCA | CD137/41BB | OX40 | DAP12 |
| BCA | CD137/41BB | OX40 | CD32 |
| BCA | CD137/41BB | OX40 | CD79a |
| BCA | CD137/41BB | OX40 | CD79b |
| BCA | CD137/41BB | DAP10 | CD8 |
| BCA | CD137/41BB | DAP10 | CD3ζ |
| BCA | CD137/41BB | DAP10 | CD3δ |
| BCA | CD137/41BB | DAP10 | CD3γ |
| BCA | CD137/41BB | DAP10 | CD3ε |
| BCA | CD137/41BB | DAP10 | FcγRI-γ |
| BCA | CD137/41BB | DAP10 | FcγRIII-γ |

TABLE 3-continued

Third Generation CARs

| ScFv | Co-stimulatory Signal | Co-stimulatory Signal | Signal Domain |
|---|---|---|---|
| BCA | CD137/41BB | DAP10 | FcεRIβ |
| BCA | CD137/41BB | DAP10 | FcεRIγ |
| BCA | CD137/41BB | DAP10 | DAP12 |
| BCA | CD137/41BB | DAP10 | CD32 |
| BCA | CD137/41BB | DAP10 | CD79a |
| BCA | CD137/41BB | DAP10 | CD79b |
| BCA | CD137/41BB | DAP12 | CD8 |
| BCA | CD137/41BB | DAP12 | CD3ζ |
| BCA | CD137/41BB | DAP12 | CD3δ |
| BCA | CD137/41BB | DAP12 | CD3γ |
| BCA | CD137/41BB | DAP12 | CD3ε |
| BCA | CD137/41BB | DAP12 | FcγRI-γ |
| BCA | CD137/41BB | DAP12 | FcγRIII-γ |
| BCA | CD137/41BB | DAP12 | FcεRIβ |
| BCA | CD137/41BB | DAP12 | FcεRIγ |
| BCA | CD137/41BB | DAP12 | DAP10 |
| BCA | CD137/41BB | DAP12 | DAP12 |
| BCA | CD137/41BB | DAP12 | CD32 |
| BCA | CD137/41BB | DAP12 | CD79a |
| BCA | CD137/41BB | DAP12 | CD79b |
| BCA | CD137/41BB | MyD88 | CD8 |
| BCA | CD137/41BB | MyD88 | CD3ζ |
| BCA | CD137/41BB | MyD88 | CD3δ |
| BCA | CD137/41BB | MyD88 | CD3γ |
| BCA | CD137/41BB | MyD88 | CD3ε |
| BCA | CD137/41BB | MyD88 | FcγRI-γ |
| BCA | CD137/41BB | MyD88 | FcγRIII-γ |
| BCA | CD137/41BB | MyD88 | FcεRIβ |
| BCA | CD137/41BB | MyD88 | FcεRIγ |
| BCA | CD137/41BB | MyD88 | DAP10 |
| BCA | CD137/41BB | MyD88 | DAP12 |
| BCA | CD137/41BB | MyD88 | CD32 |
| BCA | CD137/41BB | MyD88 | CD79a |
| BCA | CD137/41BB | MyD88 | CD79b |
| BCA | CD137/41BB | CD7 | CD8 |
| BCA | CD137/41BB | CD7 | CD3ζ |
| BCA | CD137/41BB | CD7 | CD3δ |
| BCA | CD137/41BB | CD7 | CD3γ |
| BCA | CD137/41BB | CD7 | CD3ε |
| BCA | CD137/41BB | CD7 | FcγRI-γ |
| BCA | CD137/41BB | CD7 | FcγRIII-γ |
| BCA | CD137/41BB | CD7 | FcεRIβ |
| BCA | CD137/41BB | CD7 | FcεRIγ |
| BCA | CD137/41BB | CD7 | DAP10 |
| BCA | CD137/41BB | CD7 | DAP12 |
| BCA | CD137/41BB | CD7 | CD32 |
| BCA | CD137/41BB | CD7 | CD79a |
| BCA | CD137/41BB | CD7 | CD79b |
| BCA | CD137/41BB | BTNL3 | CD8 |
| BCA | CD137/41BB | BTNL3 | CD3ζ |
| BCA | CD137/41BB | BTNL3 | CD3δ |
| BCA | CD137/41BB | BTNL3 | CD3γ |
| BCA | CD137/41BB | BTNL3 | CD3ε |
| BCA | CD137/41BB | BTNL3 | FcγRI-γ |
| BCA | CD137/41BB | BTNL3 | FcγRIII-γ |
| BCA | CD137/41BB | BTNL3 | FcεRIβ |
| BCA | CD137/41BB | BTNL3 | FcεRIγ |
| BCA | CD137/41BB | BTNL3 | DAP10 |
| BCA | CD137/41BB | BTNL3 | DAP12 |
| BCA | CD137/41BB | BTNL3 | CD32 |
| BCA | CD137/41BB | BTNL3 | CD79a |
| BCA | CD137/41BB | BTNL3 | CD79b |
| BCA | CD137/41BB | NKG2D | CD8 |
| BCA | CD137/41BB | NKG2D | CD3ζ |
| BCA | CD137/41BB | NKG2D | CD3δ |
| BCA | CD137/41BB | NKG2D | CD3γ |
| BCA | CD137/41BB | NKG2D | CD3ε |
| BCA | CD137/41BB | NKG2D | FcγRI-γ |
| BCA | CD137/41BB | NKG2D | FcγRIII-γ |
| BCA | CD137/41BB | NKG2D | FcεRIβ |
| BCA | CD137/41BB | NKG2D | FcεRIγ |
| BCA | CD137/41BB | NKG2D | DAP10 |
| BCA | CD137/41BB | NKG2D | DAP12 |
| BCA | CD137/41BB | NKG2D | CD32 |
| BCA | CD137/41BB | NKG2D | CD79a |
| BCA | CD137/41BB | NKG2D | CD79b |
| BCA | ICOS | CD28 | CD8 |
| BCA | ICOS | CD28 | CD3ζ |
| BCA | ICOS | CD28 | CD3δ |
| BCA | ICOS | CD28 | CD3γ |
| BCA | ICOS | CD28 | CD3ε |
| BCA | ICOS | CD28 | FcγRI-γ |
| BCA | ICOS | CD28 | FcγRIII-γ |
| BCA | ICOS | CD28 | FcεRIβ |
| BCA | ICOS | CD28 | FcεRIγ |
| BCA | ICOS | CD28 | DAP10 |
| BCA | ICOS | CD28 | DAP12 |
| BCA | ICOS | CD28 | CD32 |
| BCA | ICOS | CD28 | CD79a |
| BCA | ICOS | CD28 | CD79b |
| BCA | ICOS | CD8 | CD8 |
| BCA | ICOS | CD8 | CD3ζ |
| BCA | ICOS | CD8 | CD3δ |
| BCA | ICOS | CD8 | CD3γ |
| BCA | ICOS | CD8 | CD3ε |
| BCA | ICOS | CD8 | FcγRI-γ |
| BCA | ICOS | CD8 | FcγRIII-γ |
| BCA | ICOS | CD8 | FcεRIβ |
| BCA | ICOS | CD8 | FcεRIγ |
| BCA | ICOS | CD8 | DAP10 |
| BCA | ICOS | CD8 | DAP12 |
| BCA | ICOS | CD8 | CD32 |
| BCA | ICOS | CD8 | CD79a |
| BCA | ICOS | CD8 | CD79b |
| BCA | ICOS | CD4 | CD8 |
| BCA | ICOS | CD4 | CD3ζ |
| BCA | ICOS | CD4 | CD3δ |
| BCA | ICOS | CD4 | CD3γ |
| BCA | ICOS | CD4 | CD3ε |
| BCA | ICOS | CD4 | FcγRI-γ |
| BCA | ICOS | CD4 | FcγRIII-γ |
| BCA | ICOS | CD4 | FcεRIβ |
| BCA | ICOS | CD4 | FcεRIγ |
| BCA | ICOS | CD4 | DAP10 |
| BCA | ICOS | CD4 | DAP12 |
| BCA | ICOS | CD4 | CD32 |
| BCA | ICOS | CD4 | CD79a |
| BCA | ICOS | CD4 | CD79b |
| BCA | ICOS | b2c | CD8 |
| BCA | ICOS | b2c | CD3ζ |
| BCA | ICOS | b2c | CD3δ |
| BCA | ICOS | b2c | CD3γ |
| BCA | ICOS | b2c | CD3ε |
| BCA | ICOS | b2c | FcγRI-γ |
| BCA | ICOS | b2c | FcγRIII-γ |
| BCA | ICOS | b2c | FcεRIβ |
| BCA | ICOS | b2c | FcεRIγ |
| BCA | ICOS | b2c | DAP10 |
| BCA | ICOS | b2c | DAP12 |
| BCA | ICOS | b2c | CD32 |
| BCA | ICOS | b2c | CD79a |
| BCA | ICOS | b2c | CD79b |
| BCA | ICOS | CD137/41BB | CD8 |
| BCA | ICOS | CD137/41BB | CD3ζ |
| BCA | ICOS | CD137/41BB | CD3δ |
| BCA | ICOS | CD137/41BB | CD3γ |
| BCA | ICOS | CD137/41BB | CD3ε |
| BCA | ICOS | CD137/41BB | FcγRI-γ |
| BCA | ICOS | CD137/41BB | FcγRIII-γ |
| BCA | ICOS | CD137/41BB | FcεRIβ |
| BCA | ICOS | CD137/41BB | FcεRIγ |
| BCA | ICOS | CD137/41BB | DAP10 |
| BCA | ICOS | CD137/41BB | DAP12 |
| BCA | ICOS | CD137/41BB | CD32 |
| BCA | ICOS | CD137/41BB | CD79a |
| BCA | ICOS | CD137/41BB | CD79b |
| BCA | ICOS | ICOS | CD8 |
| BCA | ICOS | ICOS | CD3ζ |
| BCA | ICOS | ICOS | CD3δ |

TABLE 3-continued

Third Generation CARs

| ScFv | Co-stimulatory Signal | Co-stimulatory Signal | Signal Domain |
|---|---|---|---|
| BCA | ICOS | ICOS | CD3γ |
| BCA | ICOS | ICOS | CD3ε |
| BCA | ICOS | ICOS | FcγRI-γ |
| BCA | ICOS | ICOS | FcγRIII-γ |
| BCA | ICOS | ICOS | FcεRIβ |
| BCA | ICOS | ICOS | FcεRIγ |
| BCA | ICOS | ICOS | DAP10 |
| BCA | ICOS | ICOS | DAP12 |
| BCA | ICOS | ICOS | CD32 |
| BCA | ICOS | ICOS | CD79a |
| BCA | ICOS | ICOS | CD79b |
| BCA | ICOS | CD27 | CD8 |
| BCA | ICOS | CD27 | CD3ζ |
| BCA | ICOS | CD27 | CD3δ |
| BCA | ICOS | CD27 | CD3γ |
| BCA | ICOS | CD27 | CD3ε |
| BCA | ICOS | CD27 | FcγRI-γ |
| BCA | ICOS | CD27 | FcγRIII-γ |
| BCA | ICOS | CD27 | FcεRIβ |
| BCA | ICOS | CD27 | FcεRIγ |
| BCA | ICOS | CD27 | DAP10 |
| BCA | ICOS | CD27 | DAP12 |
| BCA | ICOS | CD27 | CD32 |
| BCA | ICOS | CD27 | CD79a |
| BCA | ICOS | CD27 | CD79b |
| BCA | ICOS | CD28δ | CD8 |
| BCA | ICOS | CD28δ | CD3ζ |
| BCA | ICOS | CD28δ | CD3δ |
| BCA | ICOS | CD28δ | CD3γ |
| BCA | ICOS | CD28δ | CD3ε |
| BCA | ICOS | CD28δ | FcγRI-γ |
| BCA | ICOS | CD28δ | FcγRIII-γ |
| BCA | ICOS | CD28δ | FcεRIβ |
| BCA | ICOS | CD28δ | FcεRIγ |
| BCA | ICOS | CD28δ | DAP10 |
| BCA | ICOS | CD28δ | DAP12 |
| BCA | ICOS | CD28δ | CD32 |
| BCA | ICOS | CD28δ | CD79a |
| BCA | ICOS | CD28δ | CD79b |
| BCA | ICOS | CD80 | CD8 |
| BCA | ICOS | CD80 | CD3ζ |
| BCA | ICOS | CD80 | CD3δ |
| BCA | ICOS | CD80 | CD3γ |
| BCA | ICOS | CD80 | CD3ε |
| BCA | ICOS | CD80 | FcγRI-γ |
| BCA | ICOS | CD80 | FcγRIII-γ |
| BCA | ICOS | CD80 | FcεRIβ |
| BCA | ICOS | CD80 | FcεRIγ |
| BCA | ICOS | CD80 | DAP10 |
| BCA | ICOS | CD80 | DAP12 |
| BCA | ICOS | CD80 | CD32 |
| BCA | ICOS | CD80 | CD79a |
| BCA | ICOS | CD80 | CD79b |
| BCA | ICOS | CD86 | CD8 |
| BCA | ICOS | CD86 | CD3ζ |
| BCA | ICOS | CD86 | CD3δ |
| BCA | ICOS | CD86 | CD3γ |
| BCA | ICOS | CD86 | CD3ε |
| BCA | ICOS | CD86 | FcγRI-γ |
| BCA | ICOS | CD86 | FcγRIII-γ |
| BCA | ICOS | CD86 | FcεRIβ |
| BCA | ICOS | CD86 | FcεRIγ |
| BCA | ICOS | CD86 | DAP10 |
| BCA | ICOS | CD86 | DAP12 |
| BCA | ICOS | CD86 | CD32 |
| BCA | ICOS | CD86 | CD79a |
| BCA | ICOS | CD86 | CD79b |
| BCA | ICOS | OX40 | CD8 |
| BCA | ICOS | OX40 | CD3ζ |
| BCA | ICOS | OX40 | CD3δ |
| BCA | ICOS | OX40 | CD3γ |
| BCA | ICOS | OX40 | CD3ε |
| BCA | ICOS | OX40 | FcγRI-γ |
| BCA | ICOS | OX40 | FcγRIII-γ |
| BCA | ICOS | OX40 | FcεRIβ |
| BCA | ICOS | OX40 | FcεRIγ |
| BCA | ICOS | OX40 | DAP10 |
| BCA | ICOS | OX40 | DAP12 |
| BCA | ICOS | OX40 | CD32 |
| BCA | ICOS | OX40 | CD79a |
| BCA | ICOS | OX40 | CD79b |
| BCA | ICOS | DAP10 | CD8 |
| BCA | ICOS | DAP10 | CD3ζ |
| BCA | ICOS | DAP10 | CD3δ |
| BCA | ICOS | DAP10 | CD3γ |
| BCA | ICOS | DAP10 | CD3ε |
| BCA | ICOS | DAP10 | FcγRI-γ |
| BCA | ICOS | DAP10 | FcγRIII-γ |
| BCA | ICOS | DAP10 | FcεRIβ |
| BCA | ICOS | DAP10 | FcεRIγ |
| BCA | ICOS | DAP10 | DAP10 |
| BCA | ICOS | DAP10 | DAP12 |
| BCA | ICOS | DAP10 | CD32 |
| BCA | ICOS | DAP10 | CD79a |
| BCA | ICOS | DAP10 | CD79b |
| BCA | ICOS | DAP12 | CD8 |
| BCA | ICOS | DAP12 | CD3ζ |
| BCA | ICOS | DAP12 | CD3δ |
| BCA | ICOS | DAP12 | CD3γ |
| BCA | ICOS | DAP12 | CD3ε |
| BCA | ICOS | DAP12 | FcγRI-γ |
| BCA | ICOS | DAP12 | FcγRIII-γ |
| BCA | ICOS | DAP12 | FcεRIβ |
| BCA | ICOS | DAP12 | FcεRIγ |
| BCA | ICOS | DAP12 | DAP10 |
| BCA | ICOS | DAP12 | DAP12 |
| BCA | ICOS | DAP12 | CD32 |
| BCA | ICOS | DAP12 | CD79a |
| BCA | ICOS | DAP12 | CD79b |
| BCA | ICOS | MyD88 | CD8 |
| BCA | ICOS | MyD88 | CD3ζ |
| BCA | ICOS | MyD88 | CD3δ |
| BCA | ICOS | MyD88 | CD3γ |
| BCA | ICOS | MyD88 | CD3ε |
| BCA | ICOS | MyD88 | FcγRI-γ |
| BCA | ICOS | MyD88 | FcγRIII-γ |
| BCA | ICOS | MyD88 | FcεRIβ |
| BCA | ICOS | MyD88 | FcεRIγ |
| BCA | ICOS | MyD88 | DAP10 |
| BCA | ICOS | MyD88 | DAP12 |
| BCA | ICOS | MyD88 | CD32 |
| BCA | ICOS | MyD88 | CD79a |
| BCA | ICOS | MyD88 | CD79b |
| BCA | ICOS | CD7 | CD8 |
| BCA | ICOS | CD7 | CD3ζ |
| BCA | ICOS | CD7 | CD3δ |
| BCA | ICOS | CD7 | CD3γ |
| BCA | ICOS | CD7 | CD3ε |
| BCA | ICOS | CD7 | FcγRI-γ |
| BCA | ICOS | CD7 | FcγRIII-γ |
| BCA | ICOS | CD7 | FcεRIβ |
| BCA | ICOS | CD7 | FcεRIγ |
| BCA | ICOS | CD7 | DAP10 |
| BCA | ICOS | CD7 | DAP12 |
| BCA | ICOS | CD7 | CD32 |
| BCA | ICOS | CD7 | CD79a |
| BCA | ICOS | CD7 | CD79b |
| BCA | ICOS | BTNL3 | CD8 |
| BCA | ICOS | BTNL3 | CD3ζ |
| BCA | ICOS | BTNL3 | CD3δ |
| BCA | ICOS | BTNL3 | CD3γ |
| BCA | ICOS | BTNL3 | CD3ε |
| BCA | ICOS | BTNL3 | FcγRI-γ |
| BCA | ICOS | BTNL3 | FcγRIII-γ |
| BCA | ICOS | BTNL3 | FcεRIβ |
| BCA | ICOS | BTNL3 | FcεRIγ |
| BCA | ICOS | BTNL3 | DAP10 |
| BCA | ICOS | BTNL3 | DAP12 |
| BCA | ICOS | BTNL3 | CD32 |
| BCA | ICOS | BTNL3 | CD79a |

TABLE 3-continued

Third Generation CARs

| ScFv | Co-stimulatory Signal | Co-stimulatory Signal | Signal Domain |
|---|---|---|---|
| BCA | ICOS | BTNL3 | CD79b |
| BCA | ICOS | NKG2D | CD8 |
| BCA | ICOS | NKG2D | CD3ζ |
| BCA | ICOS | NKG2D | CD3δ |
| BCA | ICOS | NKG2D | CD3γ |
| BCA | ICOS | NKG2D | CD3ε |
| BCA | ICOS | NKG2D | FcγRI-γ |
| BCA | ICOS | NKG2D | FcγRIII-γ |
| BCA | ICOS | NKG2D | FcεRIβ |
| BCA | ICOS | NKG2D | FcεRIγ |
| BCA | ICOS | NKG2D | DAP10 |
| BCA | ICOS | NKG2D | DAP12 |
| BCA | ICOS | NKG2D | CD32 |
| BCA | ICOS | NKG2D | CD79a |
| BCA | ICOS | NKG2D | CD79b |
| BCA | CD27 | CD28 | CD8 |
| BCA | CD27 | CD28 | CD3ζ |
| BCA | CD27 | CD28 | CD3δ |
| BCA | CD27 | CD28 | CD3γ |
| BCA | CD27 | CD28 | CD3ε |
| BCA | CD27 | CD28 | FcγRI-γ |
| BCA | CD27 | CD28 | FcγRIII-γ |
| BCA | CD27 | CD28 | FcεRIβ |
| BCA | CD27 | CD28 | FcεRIγ |
| BCA | CD27 | CD28 | DAP10 |
| BCA | CD27 | CD28 | DAP12 |
| BCA | CD27 | CD28 | CD32 |
| BCA | CD27 | CD28 | CD79a |
| BCA | CD27 | CD28 | CD79b |
| BCA | CD27 | CD8 | CD8 |
| BCA | CD27 | CD8 | CD3ζ |
| BCA | CD27 | CD8 | CD3δ |
| BCA | CD27 | CD8 | CD3γ |
| BCA | CD27 | CD8 | CD3ε |
| BCA | CD27 | CD8 | FcγRI-γ |
| BCA | CD27 | CD8 | FcγRIII-γ |
| BCA | CD27 | CD8 | FcεRIβ |
| BCA | CD27 | CD8 | FcεRIγ |
| BCA | CD27 | CD8 | DAP10 |
| BCA | CD27 | CD8 | DAP12 |
| BCA | CD27 | CD8 | CD32 |
| BCA | CD27 | CD8 | CD79a |
| BCA | CD27 | CD8 | CD79b |
| BCA | CD27 | CD4 | CD8 |
| BCA | CD27 | CD4 | CD3ζ |
| BCA | CD27 | CD4 | CD3δ |
| BCA | CD27 | CD4 | CD3γ |
| BCA | CD27 | CD4 | CD3ε |
| BCA | CD27 | CD4 | FcγRI-γ |
| BCA | CD27 | CD4 | FcγRIII-γ |
| BCA | CD27 | CD4 | FcεRIβ |
| BCA | CD27 | CD4 | FcεRIγ |
| BCA | CD27 | CD4 | DAP10 |
| BCA | CD27 | CD4 | DAP12 |
| BCA | CD27 | CD4 | CD32 |
| BCA | CD27 | CD4 | CD79a |
| BCA | CD27 | CD4 | CD79b |
| BCA | CD27 | b2c | CD8 |
| BCA | CD27 | b2c | CD3ζ |
| BCA | CD27 | b2c | CD3δ |
| BCA | CD27 | b2c | CD3γ |
| BCA | CD27 | b2c | CD3ε |
| BCA | CD27 | b2c | FcγRI-γ |
| BCA | CD27 | b2c | FcγRIII-γ |
| BCA | CD27 | b2c | FcεRIβ |
| BCA | CD27 | b2c | FcεRIγ |
| BCA | CD27 | b2c | DAP10 |
| BCA | CD27 | b2c | DAP12 |
| BCA | CD27 | b2c | CD32 |
| BCA | CD27 | b2c | CD79a |
| BCA | CD27 | b2c | CD79b |
| BCA | CD27 | CD137/41BB | CD8 |
| BCA | CD27 | CD137/41BB | CD3ζ |
| BCA | CD27 | CD137/41BB | CD3δ |
| BCA | CD27 | CD137/41BB | CD3γ |
| BCA | CD27 | CD137/41BB | CD3ε |
| BCA | CD27 | CD137/41BB | FcγRI-γ |
| BCA | CD27 | CD137/41BB | FcγRIII-γ |
| BCA | CD27 | CD137/41BB | FcεRIβ |
| BCA | CD27 | CD137/41BB | FcεRIγ |
| BCA | CD27 | CD137/41BB | DAP10 |
| BCA | CD27 | CD137/41BB | DAP12 |
| BCA | CD27 | CD137/41BB | CD32 |
| BCA | CD27 | CD137/41BB | CD79a |
| BCA | CD27 | CD137/41BB | CD79b |
| BCA | CD27 | ICOS | CD8 |
| BCA | CD27 | ICOS | CD3ζ |
| BCA | CD27 | ICOS | CD3δ |
| BCA | CD27 | ICOS | CD3γ |
| BCA | CD27 | ICOS | CD3ε |
| BCA | CD27 | ICOS | FcγRI-γ |
| BCA | CD27 | ICOS | FcγRIII-γ |
| BCA | CD27 | ICOS | FcεRIβ |
| BCA | CD27 | ICOS | FcεRIγ |
| BCA | CD27 | ICOS | DAP10 |
| BCA | CD27 | ICOS | DAP12 |
| BCA | CD27 | ICOS | CD32 |
| BCA | CD27 | ICOS | CD79a |
| BCA | CD27 | ICOS | CD79b |
| BCA | CD27 | CD27 | CD8 |
| BCA | CD27 | CD27 | CD3ζ |
| BCA | CD27 | CD27 | CD3δ |
| BCA | CD27 | CD27 | CD3γ |
| BCA | CD27 | CD27 | CD3ε |
| BCA | CD27 | CD27 | FcγRI-γ |
| BCA | CD27 | CD27 | FcγRIII-γ |
| BCA | CD27 | CD27 | FcεRIβ |
| BCA | CD27 | CD27 | FcεRIγ |
| BCA | CD27 | CD27 | DAP10 |
| BCA | CD27 | CD27 | DAP12 |
| BCA | CD27 | CD27 | CD32 |
| BCA | CD27 | CD27 | CD79a |
| BCA | CD27 | CD27 | CD79b |
| BCA | CD27 | CD28δ | CD8 |
| BCA | CD27 | CD28δ | CD3ζ |
| BCA | CD27 | CD28δ | CD3δ |
| BCA | CD27 | CD28δ | CD3γ |
| BCA | CD27 | CD28δ | CD3ε |
| BCA | CD27 | CD28δ | FcγRI-γ |
| BCA | CD27 | CD28δ | FcγRIII-γ |
| BCA | CD27 | CD28δ | FcεRIβ |
| BCA | CD27 | CD28δ | FcεRIγ |
| BCA | CD27 | CD28δ | DAP10 |
| BCA | CD27 | CD28δ | DAP12 |
| BCA | CD27 | CD28δ | CD32 |
| BCA | CD27 | CD28δ | CD79a |
| BCA | CD27 | CD28δ | CD79b |
| BCA | CD27 | CD80 | CD8 |
| BCA | CD27 | CD80 | CD3ζ |
| BCA | CD27 | CD80 | CD3δ |
| BCA | CD27 | CD80 | CD3γ |
| BCA | CD27 | CD80 | CD3ε |
| BCA | CD27 | CD80 | FcγRI-γ |
| BCA | CD27 | CD80 | FcγRIII-γ |
| BCA | CD27 | CD80 | FcεRIβ |
| BCA | CD27 | CD80 | FcεRIγ |
| BCA | CD27 | CD80 | DAP10 |
| BCA | CD27 | CD80 | DAP12 |
| BCA | CD27 | CD80 | CD32 |
| BCA | CD27 | CD80 | CD79a |
| BCA | CD27 | CD80 | CD79b |
| BCA | CD27 | CD86 | CD8 |
| BCA | CD27 | CD86 | CD3ζ |
| BCA | CD27 | CD86 | CD3δ |
| BCA | CD27 | CD86 | CD3γ |
| BCA | CD27 | CD86 | CD3ε |
| BCA | CD27 | CD86 | FcγRI-γ |
| BCA | CD27 | CD86 | FcγRIII-γ |
| BCA | CD27 | CD86 | FcεRIβ |
| BCA | CD27 | CD86 | FcεRIγ |

TABLE 3-continued

Third Generation CARs

| ScFv | Co-stimulatory Signal | Co-stimulatory Signal | Signal Domain |
|---|---|---|---|
| BCA | CD27 | CD86 | DAP10 |
| BCA | CD27 | CD86 | DAP12 |
| BCA | CD27 | CD86 | CD32 |
| BCA | CD27 | CD86 | CD79a |
| BCA | CD27 | CD86 | CD79b |
| BCA | CD27 | OX40 | CD8 |
| BCA | CD27 | OX40 | CD3ζ |
| BCA | CD27 | OX40 | CD3δ |
| BCA | CD27 | OX40 | CD3γ |
| BCA | CD27 | OX40 | CD3ε |
| BCA | CD27 | OX40 | FcγRI-γ |
| BCA | CD27 | OX40 | FcγRIII-γ |
| BCA | CD27 | OX40 | FcεRIβ |
| BCA | CD27 | OX40 | FcεRIγ |
| BCA | CD27 | OX40 | DAP10 |
| BCA | CD27 | OX40 | DAP12 |
| BCA | CD27 | OX40 | CD32 |
| BCA | CD27 | OX40 | CD79a |
| BCA | CD27 | OX40 | CD79b |
| BCA | CD27 | DAP10 | CD8 |
| BCA | CD27 | DAP10 | CD3ζ |
| BCA | CD27 | DAP10 | CD3δ |
| BCA | CD27 | DAP10 | CD3γ |
| BCA | CD27 | DAP10 | CD3ε |
| BCA | CD27 | DAP10 | FcγRI-γ |
| BCA | CD27 | DAP10 | FcγRIII-γ |
| BCA | CD27 | DAP10 | FcεRIβ |
| BCA | CD27 | DAP10 | FcεRIγ |
| BCA | CD27 | DAP10 | DAP10 |
| BCA | CD27 | DAP10 | DAP12 |
| BCA | CD27 | DAP10 | CD32 |
| BCA | CD27 | DAP10 | CD79a |
| BCA | CD27 | DAP10 | CD79b |
| BCA | CD27 | DAP12 | CD8 |
| BCA | CD27 | DAP12 | CD3ζ |
| BCA | CD27 | DAP12 | CD3δ |
| BCA | CD27 | DAP12 | CD3γ |
| BCA | CD27 | DAP12 | CD3ε |
| BCA | CD27 | DAP12 | FcγRI-γ |
| BCA | CD27 | DAP12 | FcγRIII-γ |
| BCA | CD27 | DAP12 | FcεRIβ |
| BCA | CD27 | DAP12 | FcεRIγ |
| BCA | CD27 | DAP12 | DAP10 |
| BCA | CD27 | DAP12 | DAP12 |
| BCA | CD27 | DAP12 | CD32 |
| BCA | CD27 | DAP12 | CD79a |
| BCA | CD27 | DAP12 | CD79b |
| BCA | CD27 | MyD88 | CD8 |
| BCA | CD27 | MyD88 | CD3ζ |
| BCA | CD27 | MyD88 | CD3δ |
| BCA | CD27 | MyD88 | CD3γ |
| BCA | CD27 | MyD88 | CD3ε |
| BCA | CD27 | MyD88 | FcγRI-γ |
| BCA | CD27 | MyD88 | FcγRIII-γ |
| BCA | CD27 | MyD88 | FcεRIβ |
| BCA | CD27 | MyD88 | FcεRIγ |
| BCA | CD27 | MyD88 | DAP10 |
| BCA | CD27 | MyD88 | DAP12 |
| BCA | CD27 | MyD88 | CD32 |
| BCA | CD27 | MyD88 | CD79a |
| BCA | CD27 | MyD88 | CD79b |
| BCA | CD27 | CD7 | CD8 |
| BCA | CD27 | CD7 | CD3ζ |
| BCA | CD27 | CD7 | CD3δ |
| BCA | CD27 | CD7 | CD3γ |
| BCA | CD27 | CD7 | CD3ε |
| BCA | CD27 | CD7 | FcγRI-γ |
| BCA | CD27 | CD7 | FcγRIII-γ |
| BCA | CD27 | CD7 | FcεRIβ |
| BCA | CD27 | CD7 | FcεRIγ |
| BCA | CD27 | CD7 | DAP10 |
| BCA | CD27 | CD7 | DAP12 |
| BCA | CD27 | CD7 | CD32 |
| BCA | CD27 | CD7 | CD79a |
| BCA | CD27 | CD7 | CD79b |
| BCA | CD27 | BTNL3 | CD8 |
| BCA | CD27 | BTNL3 | CD3ζ |
| BCA | CD27 | BTNL3 | CD3δ |
| BCA | CD27 | BTNL3 | CD3γ |
| BCA | CD27 | BTNL3 | CD3ε |
| BCA | CD27 | BTNL3 | FcγRI-γ |
| BCA | CD27 | BTNL3 | FcγRIII-γ |
| BCA | CD27 | BTNL3 | FcεRIβ |
| BCA | CD27 | BTNL3 | FcεRIγ |
| BCA | CD27 | BTNL3 | DAP10 |
| BCA | CD27 | BTNL3 | DAP12 |
| BCA | CD27 | BTNL3 | CD32 |
| BCA | CD27 | BTNL3 | CD79a |
| BCA | CD27 | BTNL3 | CD79b |
| BCA | CD27 | NKG2D | CD8 |
| BCA | CD27 | NKG2D | CD3ζ |
| BCA | CD27 | NKG2D | CD3δ |
| BCA | CD27 | NKG2D | CD3γ |
| BCA | CD27 | NKG2D | CD3ε |
| BCA | CD27 | NKG2D | FcγRI-γ |
| BCA | CD27 | NKG2D | FcγRIII-γ |
| BCA | CD27 | NKG2D | FcεRIβ |
| BCA | CD27 | NKG2D | FcεRIγ |
| BCA | CD27 | NKG2D | DAP10 |
| BCA | CD27 | NKG2D | DAP12 |
| BCA | CD27 | NKG2D | CD32 |
| BCA | CD27 | NKG2D | CD79a |
| BCA | CD27 | NKG2D | CD79b |
| BCA | CD28δ | CD28 | CD8 |
| BCA | CD28δ | CD28 | CD3ζ |
| BCA | CD28δ | CD28 | CD3δ |
| BCA | CD28δ | CD28 | CD3γ |
| BCA | CD28δ | CD28 | CD3ε |
| BCA | CD28δ | CD28 | FcγRI-γ |
| BCA | CD28δ | CD28 | FcγRIII-γ |
| BCA | CD28δ | CD28 | FcεRIβ |
| BCA | CD28δ | CD28 | FcεRIγ |
| BCA | CD28δ | CD28 | DAP10 |
| BCA | CD28δ | CD28 | DAP12 |
| BCA | CD28δ | CD28 | CD32 |
| BCA | CD28δ | CD28 | CD79a |
| BCA | CD28δ | CD28 | CD79b |
| BCA | CD28δ | CD8 | CD8 |
| BCA | CD28δ | CD8 | CD3ζ |
| BCA | CD28δ | CD8 | CD3δ |
| BCA | CD28δ | CD8 | CD3γ |
| BCA | CD28δ | CD8 | CD3ε |
| BCA | CD28δ | CD8 | FcγRI-γ |
| BCA | CD28δ | CD8 | FcγRIII-γ |
| BCA | CD28δ | CD8 | FcεRIβ |
| BCA | CD28δ | CD8 | FcεRIγ |
| BCA | CD28δ | CD8 | DAP10 |
| BCA | CD28δ | CD8 | DAP12 |
| BCA | CD28δ | CD8 | CD32 |
| BCA | CD28δ | CD8 | CD79a |
| BCA | CD28δ | CD8 | CD79b |
| BCA | CD28δ | CD4 | CD8 |
| BCA | CD28δ | CD4 | CD3ζ |
| BCA | CD28δ | CD4 | CD3δ |
| BCA | CD28δ | CD4 | CD3γ |
| BCA | CD28δ | CD4 | CD3ε |
| BCA | CD28δ | CD4 | FcγRI-γ |
| BCA | CD28δ | CD4 | FcγRIII-γ |
| BCA | CD28δ | CD4 | FcεRIβ |
| BCA | CD28δ | CD4 | FcεRIγ |
| BCA | CD28δ | CD4 | DAP10 |
| BCA | CD28δ | CD4 | DAP12 |
| BCA | CD28δ | CD4 | CD32 |
| BCA | CD28δ | CD4 | CD79a |
| BCA | CD28δ | CD4 | CD79b |
| BCA | CD28δ | b2c | CD8 |
| BCA | CD28δ | b2c | CD3ζ |
| BCA | CD28δ | b2c | CD3δ |
| BCA | CD28δ | b2c | CD3γ |
| BCA | CD28δ | b2c | CD3ε |

TABLE 3-continued

Third Generation CARs

| ScFv | Co-stimulatory Signal | Co-stimulatory Signal | Signal Domain |
|---|---|---|---|
| BCA | CD28δ | b2c | FcγRI-γ |
| BCA | CD28δ | b2c | FcγRIII-γ |
| BCA | CD28δ | b2c | FcεRIβ |
| BCA | CD28δ | b2c | FcεRIγ |
| BCA | CD28δ | b2c | DAP10 |
| BCA | CD28δ | b2c | DAP12 |
| BCA | CD28δ | b2c | CD32 |
| BCA | CD28δ | b2c | CD79a |
| BCA | CD28δ | b2c | CD79b |
| BCA | CD28δ | CD137/41BB | CD8 |
| BCA | CD28δ | CD137/41BB | CD3ζ |
| BCA | CD28δ | CD137/41BB | CD3δ |
| BCA | CD28δ | CD137/41BB | CD3γ |
| BCA | CD28δ | CD137/41BB | CD3ε |
| BCA | CD28δ | CD137/41BB | FcγRI-γ |
| BCA | CD28δ | CD137/41BB | FcγRIII-γ |
| BCA | CD28δ | CD137/41BB | FcεRIβ |
| BCA | CD28δ | CD137/41BB | FcεRIγ |
| BCA | CD28δ | CD137/41BB | DAP10 |
| BCA | CD28δ | CD137/41BB | DAP12 |
| BCA | CD28δ | CD137/41BB | CD32 |
| BCA | CD28δ | CD137/41BB | CD79a |
| BCA | CD28δ | CD137/41BB | CD79b |
| BCA | CD28δ | ICOS | CD8 |
| BCA | CD28δ | ICOS | CD3ζ |
| BCA | CD28δ | ICOS | CD3δ |
| BCA | CD28δ | ICOS | CD3γ |
| BCA | CD28δ | ICOS | CD3ε |
| BCA | CD28δ | ICOS | FcγRI-γ |
| BCA | CD28δ | ICOS | FcγRIII-γ |
| BCA | CD28δ | ICOS | FcεRIβ |
| BCA | CD28δ | ICOS | FcεRIγ |
| BCA | CD28δ | ICOS | DAP10 |
| BCA | CD28δ | ICOS | DAP12 |
| BCA | CD28δ | ICOS | CD32 |
| BCA | CD28δ | ICOS | CD79a |
| BCA | CD28δ | ICOS | CD79b |
| BCA | CD28δ | CD27 | CD8 |
| BCA | CD28δ | CD27 | CD3ζ |
| BCA | CD28δ | CD27 | CD3δ |
| BCA | CD28δ | CD27 | CD3γ |
| BCA | CD28δ | CD27 | CD3ε |
| BCA | CD28δ | CD27 | FcγRI-γ |
| BCA | CD28δ | CD27 | FcγRIII-γ |
| BCA | CD28δ | CD27 | FcεRIβ |
| BCA | CD28δ | CD27 | FcεRIγ |
| BCA | CD28δ | CD27 | DAP10 |
| BCA | CD28δ | CD27 | DAP12 |
| BCA | CD28δ | CD27 | CD32 |
| BCA | CD28δ | CD27 | CD79a |
| BCA | CD28δ | CD27 | CD79b |
| BCA | CD28δ | CD28δ | CD8 |
| BCA | CD28δ | CD28δ | CD3ζ |
| BCA | CD28δ | CD28δ | CD3δ |
| BCA | CD28δ | CD28δ | CD3γ |
| BCA | CD28δ | CD28δ | CD3ε |
| BCA | CD28δ | CD28δ | FcγRI-γ |
| BCA | CD28δ | CD28δ | FcγRIII-γ |
| BCA | CD28δ | CD28δ | FcεRIβ |
| BCA | CD28δ | CD28δ | FcεRIγ |
| BCA | CD28δ | CD28δ | DAP10 |
| BCA | CD28δ | CD28δ | DAP12 |
| BCA | CD28δ | CD28δ | CD32 |
| BCA | CD28δ | CD28δ | CD79a |
| BCA | CD28δ | CD28δ | CD79b |
| BCA | CD28δ | CD80 | CD8 |
| BCA | CD28δ | CD80 | CD3ζ |
| BCA | CD28δ | CD80 | CD3δ |
| BCA | CD28δ | CD80 | CD3γ |
| BCA | CD28δ | CD80 | CD3ε |
| BCA | CD28δ | CD80 | FcγRI-γ |
| BCA | CD28δ | CD80 | FcγRIII-γ |
| BCA | CD28δ | CD80 | FcεRIβ |
| BCA | CD28δ | CD80 | FcεRIγ |
| BCA | CD28δ | CD80 | DAP10 |
| BCA | CD28δ | CD80 | DAP12 |
| BCA | CD28δ | CD80 | CD32 |
| BCA | CD28δ | CD80 | CD79a |
| BCA | CD28δ | CD80 | CD79b |
| BCA | CD28δ | CD86 | CD8 |
| BCA | CD28δ | CD86 | CD3ζ |
| BCA | CD28δ | CD86 | CD3δ |
| BCA | CD28δ | CD86 | CD3γ |
| BCA | CD28δ | CD86 | CD3ε |
| BCA | CD28δ | CD86 | FcγRI-γ |
| BCA | CD28δ | CD86 | FcγRIII-γ |
| BCA | CD28δ | CD86 | FcεRIβ |
| BCA | CD28δ | CD86 | FcεRIγ |
| BCA | CD28δ | CD86 | DAP10 |
| BCA | CD28δ | CD86 | DAP12 |
| BCA | CD28δ | CD86 | CD32 |
| BCA | CD28δ | CD86 | CD79a |
| BCA | CD28δ | CD86 | CD79b |
| BCA | CD28δ | OX40 | CD8 |
| BCA | CD28δ | OX40 | CD3ζ |
| BCA | CD28δ | OX40 | CD3δ |
| BCA | CD28δ | OX40 | CD3γ |
| BCA | CD28δ | OX40 | CD3ε |
| BCA | CD28δ | OX40 | FcγRI-γ |
| BCA | CD28δ | OX40 | FcγRIII-γ |
| BCA | CD28δ | OX40 | FcεRIβ |
| BCA | CD28δ | OX40 | FcεRIγ |
| BCA | CD28δ | OX40 | DAP10 |
| BCA | CD28δ | OX40 | DAP12 |
| BCA | CD28δ | OX40 | CD32 |
| BCA | CD28δ | OX40 | CD79a |
| BCA | CD28δ | OX40 | CD79b |
| BCA | CD28δ | DAP10 | CD8 |
| BCA | CD28δ | DAP10 | CD3ζ |
| BCA | CD28δ | DAP10 | CD3δ |
| BCA | CD28δ | DAP10 | CD3γ |
| BCA | CD28δ | DAP10 | CD3ε |
| BCA | CD28δ | DAP10 | FcγRI-γ |
| BCA | CD28δ | DAP10 | FcγRIII-γ |
| BCA | CD28δ | DAP10 | FcεRIβ |
| BCA | CD28δ | DAP10 | FcεRIγ |
| BCA | CD28δ | DAP10 | DAP10 |
| BCA | CD28δ | DAP10 | DAP12 |
| BCA | CD28δ | DAP10 | CD32 |
| BCA | CD28δ | DAP10 | CD79a |
| BCA | CD28δ | DAP10 | CD79b |
| BCA | CD28δ | DAP12 | CD8 |
| BCA | CD28δ | DAP12 | CD3ζ |
| BCA | CD28δ | DAP12 | CD3δ |
| BCA | CD28δ | DAP12 | CD3γ |
| BCA | CD28δ | DAP12 | CD3ε |
| BCA | CD28δ | DAP12 | FcγRI-γ |
| BCA | CD28δ | DAP12 | FcγRIII-γ |
| BCA | CD28δ | DAP12 | FcεRIβ |
| BCA | CD28δ | DAP12 | FcεRIγ |
| BCA | CD28δ | DAP12 | DAP10 |
| BCA | CD28δ | DAP12 | DAP12 |
| BCA | CD28δ | DAP12 | CD32 |
| BCA | CD28δ | DAP12 | CD79a |
| BCA | CD28δ | DAP12 | CD79b |
| BCA | CD28δ | MyD88 | CD8 |
| BCA | CD28δ | MyD88 | CD3ζ |
| BCA | CD28δ | MyD88 | CD3δ |
| BCA | CD28δ | MyD88 | CD3γ |
| BCA | CD28δ | MyD88 | CD3ε |
| BCA | CD28δ | MyD88 | FcγRI-γ |
| BCA | CD28δ | MyD88 | FcγRIII-γ |
| BCA | CD28δ | MyD88 | FcεRIβ |
| BCA | CD28δ | MyD88 | FcεRIγ |
| BCA | CD28δ | MyD88 | DAP10 |
| BCA | CD28δ | MyD88 | DAP12 |
| BCA | CD28δ | MyD88 | CD32 |
| BCA | CD28δ | MyD88 | CD79a |
| BCA | CD28δ | MyD88 | CD79b |
| BCA | CD28δ | CD7 | CD8 |

TABLE 3-continued

| Third Generation CARs | | | |
|---|---|---|---|
| ScFv | Co-stimulatory Signal | Co-stimulatory Signal | Signal Domain |
| BCA | CD28δ | CD7 | CD3ζ |
| BCA | CD28δ | CD7 | CD3δ |
| BCA | CD28δ | CD7 | CD3γ |
| BCA | CD28δ | CD7 | CD3ε |
| BCA | CD28δ | CD7 | FcγRI-γ |
| BCA | CD28δ | CD7 | FcγRIII-γ |
| BCA | CD28δ | CD7 | FcεRIβ |
| BCA | CD28δ | CD7 | FcεRIγ |
| BCA | CD28δ | CD7 | DAP10 |
| BCA | CD28δ | CD7 | DAP12 |
| BCA | CD28δ | CD7 | CD32 |
| BCA | CD28δ | CD7 | CD79a |
| BCA | CD28δ | CD7 | CD79b |
| BCA | CD28δ | BTNL3 | CD8 |
| BCA | CD28δ | BTNL3 | CD3ζ |
| BCA | CD28δ | BTNL3 | CD3δ |
| BCA | CD28δ | BTNL3 | CD3γ |
| BCA | CD28δ | BTNL3 | CD3ε |
| BCA | CD28δ | BTNL3 | FcγRI-γ |
| BCA | CD28δ | BTNL3 | FcγRIII-γ |
| BCA | CD28δ | BTNL3 | FcεRIβ |
| BCA | CD28δ | BTNL3 | FcεRIγ |
| BCA | CD28δ | BTNL3 | DAP10 |
| BCA | CD28δ | BTNL3 | DAP12 |
| BCA | CD28δ | BTNL3 | CD32 |
| BCA | CD28δ | BTNL3 | CD79a |
| BCA | CD28δ | BTNL3 | CD79b |
| BCA | CD28δ | NKG2D | CD8 |
| BCA | CD28δ | NKG2D | CD3ζ |
| BCA | CD28δ | NKG2D | CD3δ |
| BCA | CD28δ | NKG2D | CD3γ |
| BCA | CD28δ | NKG2D | CD3ε |
| BCA | CD28δ | NKG2D | FcγRI-γ |
| BCA | CD28δ | NKG2D | FcγRIII-γ |
| BCA | CD28δ | NKG2D | FcεRIβ |
| BCA | CD28δ | NKG2D | FcεRIγ |
| BCA | CD28δ | NKG2D | DAP10 |
| BCA | CD28δ | NKG2D | DAP12 |
| BCA | CD28δ | NKG2D | CD32 |
| BCA | CD28δ | NKG2D | CD79a |
| BCA | CD28δ | NKG2D | CD79b |
| BCA | CD80 | CD28 | CD8 |
| BCA | CD80 | CD28 | CD3ζ |
| BCA | CD80 | CD28 | CD3δ |
| BCA | CD80 | CD28 | CD3γ |
| BCA | CD80 | CD28 | CD3ε |
| BCA | CD80 | CD28 | FcγRI-γ |
| BCA | CD80 | CD28 | FcγRIII-γ |
| BCA | CD80 | CD28 | FcεRIβ |
| BCA | CD80 | CD28 | FcεRIγ |
| BCA | CD80 | CD28 | DAP10 |
| BCA | CD80 | CD28 | DAP12 |
| BCA | CD80 | CD28 | CD32 |
| BCA | CD80 | CD28 | CD79a |
| BCA | CD80 | CD28 | CD79b |
| BCA | CD80 | CD8 | CD8 |
| BCA | CD80 | CD8 | CD3ζ |
| BCA | CD80 | CD8 | CD3δ |
| BCA | CD80 | CD8 | CD3γ |
| BCA | CD80 | CD8 | CD3ε |
| BCA | CD80 | CD8 | FcγRI-γ |
| BCA | CD80 | CD8 | FcγRIII-γ |
| BCA | CD80 | CD8 | FcεRIβ |
| BCA | CD80 | CD8 | FcεRIγ |
| BCA | CD80 | CD8 | DAP10 |
| BCA | CD80 | CD8 | DAP12 |
| BCA | CD80 | CD8 | CD32 |
| BCA | CD80 | CD8 | CD79a |
| BCA | CD80 | CD8 | CD79b |
| BCA | CD80 | CD4 | CD8 |
| BCA | CD80 | CD4 | CD3δ |
| BCA | CD80 | CD4 | CD3γ |
| BCA | CD80 | CD4 | CD3ε |
| BCA | CD80 | CD4 | FcγRI-γ |
| BCA | CD80 | CD4 | FcγRIII-γ |
| BCA | CD80 | CD4 | FcεRIβ |
| BCA | CD80 | CD4 | FcεRIγ |
| BCA | CD80 | CD4 | DAP10 |
| BCA | CD80 | CD4 | DAP12 |
| BCA | CD80 | CD4 | CD32 |
| BCA | CD80 | CD4 | CD79a |
| BCA | CD80 | CD4 | CD79b |
| BCA | CD80 | b2c | CD8 |
| BCA | CD80 | b2c | CD3ζ |
| BCA | CD80 | b2c | CD3δ |
| BCA | CD80 | b2c | CD3γ |
| BCA | CD80 | b2c | CD3ε |
| BCA | CD80 | b2c | FcγRI-γ |
| BCA | CD80 | b2c | FcγRIII-γ |
| BCA | CD80 | b2c | FcεRIβ |
| BCA | CD80 | b2c | FcεRIγ |
| BCA | CD80 | b2c | DAP10 |
| BCA | CD80 | b2c | DAP12 |
| BCA | CD80 | b2c | CD32 |
| BCA | CD80 | b2c | CD79a |
| BCA | CD80 | b2c | CD79b |
| BCA | CD80 | CD137/41BB | CD8 |
| BCA | CD80 | CD137/41BB | CD3ζ |
| BCA | CD80 | CD137/41BB | CD3δ |
| BCA | CD80 | CD137/41BB | CD3γ |
| BCA | CD80 | CD137/41BB | CD3ε |
| BCA | CD80 | CD137/41BB | FcγRI-γ |
| BCA | CD80 | CD137/41BB | FcγRIII-γ |
| BCA | CD80 | CD137/41BB | FcεRIβ |
| BCA | CD80 | CD137/41BB | FcεRIγ |
| BCA | CD80 | CD137/41BB | DAP10 |
| BCA | CD80 | CD137/41BB | DAP12 |
| BCA | CD80 | CD137/41BB | CD32 |
| BCA | CD80 | CD137/41BB | CD79a |
| BCA | CD80 | CD137/41BB | CD79b |
| BCA | CD80 | ICOS | CD8 |
| BCA | CD80 | ICOS | CD3ζ |
| BCA | CD80 | ICOS | CD3δ |
| BCA | CD80 | ICOS | CD3γ |
| BCA | CD80 | ICOS | CD3ε |
| BCA | CD80 | ICOS | FcγRI-γ |
| BCA | CD80 | ICOS | FcγRIII-γ |
| BCA | CD80 | ICOS | FcεRIβ |
| BCA | CD80 | ICOS | FcεRIγ |
| BCA | CD80 | ICOS | DAP10 |
| BCA | CD80 | ICOS | DAP12 |
| BCA | CD80 | ICOS | CD32 |
| BCA | CD80 | ICOS | CD79a |
| BCA | CD80 | ICOS | CD79b |
| BCA | CD80 | CD27 | CD8 |
| BCA | CD80 | CD27 | CD3ζ |
| BCA | CD80 | CD27 | CD3δ |
| BCA | CD80 | CD27 | CD3γ |
| BCA | CD80 | CD27 | CD3ε |
| BCA | CD80 | CD27 | FcγRI-γ |
| BCA | CD80 | CD27 | FcγRIII-γ |
| BCA | CD80 | CD27 | FcεRIβ |
| BCA | CD80 | CD27 | FcεRIγ |
| BCA | CD80 | CD27 | DAP10 |
| BCA | CD80 | CD27 | DAP12 |
| BCA | CD80 | CD27 | CD32 |
| BCA | CD80 | CD27 | CD79a |
| BCA | CD80 | CD27 | CD79b |
| BCA | CD80 | CD28δ | CD8 |
| BCA | CD80 | CD28δ | CD3ζ |
| BCA | CD80 | CD28δ | CD3δ |
| BCA | CD80 | CD28δ | CD3γ |
| BCA | CD80 | CD28δ | CD3ε |
| BCA | CD80 | CD28δ | FcγRI-γ |
| BCA | CD80 | CD28δ | FcγRIII-γ |
| BCA | CD80 | CD28δ | FcεRIβ |
| BCA | CD80 | CD28δ | FcεRIγ |
| BCA | CD80 | CD28δ | DAP10 |
| BCA | CD80 | CD28δ | DAP12 |

TABLE 3-continued

Third Generation CARs

| ScFv | Co-stimulatory Signal | Co-stimulatory Signal | Signal Domain |
|---|---|---|---|
| BCA | CD80 | CD28δ | CD32 |
| BCA | CD80 | CD28δ | CD79a |
| BCA | CD80 | CD28δ | CD79b |
| BCA | CD80 | CD80 | CD8 |
| BCA | CD80 | CD80 | CD3ζ |
| BCA | CD80 | CD80 | CD3δ |
| BCA | CD80 | CD80 | CD3γ |
| BCA | CD80 | CD80 | CD3ε |
| BCA | CD80 | CD80 | FcγRI-γ |
| BCA | CD80 | CD80 | FcγRIII-γ |
| BCA | CD80 | CD80 | FcεRIβ |
| BCA | CD80 | CD80 | FcεRIγ |
| BCA | CD80 | CD80 | DAP10 |
| BCA | CD80 | CD80 | DAP12 |
| BCA | CD80 | CD80 | CD32 |
| BCA | CD80 | CD80 | CD79a |
| BCA | CD80 | CD80 | CD79b |
| BCA | CD80 | CD86 | CD8 |
| BCA | CD80 | CD86 | CD3ζ |
| BCA | CD80 | CD86 | CD3δ |
| BCA | CD80 | CD86 | CD3γ |
| BCA | CD80 | CD86 | CD3ε |
| BCA | CD80 | CD86 | FcγRI-γ |
| BCA | CD80 | CD86 | FcγRIII-γ |
| BCA | CD80 | CD86 | FcεRIβ |
| BCA | CD80 | CD86 | FcεRIγ |
| BCA | CD80 | CD86 | DAP10 |
| BCA | CD80 | CD86 | DAP12 |
| BCA | CD80 | CD86 | CD32 |
| BCA | CD80 | CD86 | CD79a |
| BCA | CD80 | CD86 | CD79b |
| BCA | CD80 | OX40 | CD8 |
| BCA | CD80 | OX40 | CD3ζ |
| BCA | CD80 | OX40 | CD3δ |
| BCA | CD80 | OX40 | CD3γ |
| BCA | CD80 | OX40 | CD3ε |
| BCA | CD80 | OX40 | FcγRI-γ |
| BCA | CD80 | OX40 | FcγRIII-γ |
| BCA | CD80 | OX40 | FcεRIβ |
| BCA | CD80 | OX40 | FcεRIγ |
| BCA | CD80 | OX40 | DAP10 |
| BCA | CD80 | OX40 | DAP12 |
| BCA | CD80 | OX40 | CD32 |
| BCA | CD80 | OX40 | CD79a |
| BCA | CD80 | OX40 | CD79b |
| BCA | CD80 | DAP10 | CD8 |
| BCA | CD80 | DAP10 | CD3ζ |
| BCA | CD80 | DAP10 | CD3δ |
| BCA | CD80 | DAP10 | CD3γ |
| BCA | CD80 | DAP10 | CD3ε |
| BCA | CD80 | DAP10 | FcγRI-γ |
| BCA | CD80 | DAP10 | FcγRIII-γ |
| BCA | CD80 | DAP10 | FcεRIβ |
| BCA | CD80 | DAP10 | FcεRIγ |
| BCA | CD80 | DAP10 | DAP10 |
| BCA | CD80 | DAP10 | DAP12 |
| BCA | CD80 | DAP10 | CD32 |
| BCA | CD80 | DAP10 | CD79a |
| BCA | CD80 | DAP10 | CD79b |
| BCA | CD80 | DAP12 | CD8 |
| BCA | CD80 | DAP12 | CD3ζ |
| BCA | CD80 | DAP12 | CD3δ |
| BCA | CD80 | DAP12 | CD3γ |
| BCA | CD80 | DAP12 | CD3ε |
| BCA | CD80 | DAP12 | FcγRI-γ |
| BCA | CD80 | DAP12 | FcγRIII-γ |
| BCA | CD80 | DAP12 | FcεRIβ |
| BCA | CD80 | DAP12 | FcεRIγ |
| BCA | CD80 | DAP12 | DAP10 |
| BCA | CD80 | DAP12 | DAP12 |
| BCA | CD80 | DAP12 | CD32 |
| BCA | CD80 | DAP12 | CD79a |
| BCA | CD80 | DAP12 | CD79b |
| BCA | CD80 | MyD88 | CD8 |
| BCA | CD80 | MyD88 | CD3ζ |
| BCA | CD80 | MyD88 | CD3δ |
| BCA | CD80 | MyD88 | CD3γ |
| BCA | CD80 | MyD88 | CD3ε |
| BCA | CD80 | MyD88 | FcγRI-γ |
| BCA | CD80 | MyD88 | FcγRIII-γ |
| BCA | CD80 | MyD88 | FcεRIβ |
| BCA | CD80 | MyD88 | FcεRIγ |
| BCA | CD80 | MyD88 | DAP10 |
| BCA | CD80 | MyD88 | DAP12 |
| BCA | CD80 | MyD88 | CD32 |
| BCA | CD80 | MyD88 | CD79a |
| BCA | CD80 | MyD88 | CD79b |
| BCA | CD80 | CD7 | CD8 |
| BCA | CD80 | CD7 | CD3ζ |
| BCA | CD80 | CD7 | CD3δ |
| BCA | CD80 | CD7 | CD3γ |
| BCA | CD80 | CD7 | CD3ε |
| BCA | CD80 | CD7 | FcγRI-γ |
| BCA | CD80 | CD7 | FcγRIII-γ |
| BCA | CD80 | CD7 | FcεRIβ |
| BCA | CD80 | CD7 | FcεRIγ |
| BCA | CD80 | CD7 | DAP10 |
| BCA | CD80 | CD7 | DAP12 |
| BCA | CD80 | CD7 | CD32 |
| BCA | CD80 | CD7 | CD79a |
| BCA | CD80 | CD7 | CD79b |
| BCA | CD80 | BTNL3 | CD8 |
| BCA | CD80 | BTNL3 | CD3ζ |
| BCA | CD80 | BTNL3 | CD3δ |
| BCA | CD80 | BTNL3 | CD3γ |
| BCA | CD80 | BTNL3 | CD3ε |
| BCA | CD80 | BTNL3 | FcγRI-γ |
| BCA | CD80 | BTNL3 | FcγRIII-γ |
| BCA | CD80 | BTNL3 | FcεRIβ |
| BCA | CD80 | BTNL3 | FcεRIγ |
| BCA | CD80 | BTNL3 | DAP10 |
| BCA | CD80 | BTNL3 | DAP12 |
| BCA | CD80 | BTNL3 | CD32 |
| BCA | CD80 | BTNL3 | CD79a |
| BCA | CD80 | BTNL3 | CD79b |
| BCA | CD80 | NKG2D | CD8 |
| BCA | CD80 | NKG2D | CD3ζ |
| BCA | CD80 | NKG2D | CD3δ |
| BCA | CD80 | NKG2D | CD3γ |
| BCA | CD80 | NKG2D | CD3ε |
| BCA | CD80 | NKG2D | FcγRI-γ |
| BCA | CD80 | NKG2D | FcγRIII-γ |
| BCA | CD80 | NKG2D | FcεRIβ |
| BCA | CD80 | NKG2D | FcεRIγ |
| BCA | CD80 | NKG2D | DAP10 |
| BCA | CD80 | NKG2D | DAP12 |
| BCA | CD80 | NKG2D | CD32 |
| BCA | CD80 | NKG2D | CD79a |
| BCA | CD80 | NKG2D | CD79b |
| BCA | CD86 | CD28 | CD8 |
| BCA | CD86 | CD28 | CD3ζ |
| BCA | CD86 | CD28 | CD3δ |
| BCA | CD86 | CD28 | CD3γ |
| BCA | CD86 | CD28 | CD3ε |
| BCA | CD86 | CD28 | FcγRI-γ |
| BCA | CD86 | CD28 | FcγRIII-γ |
| BCA | CD86 | CD28 | FcεRIβ |
| BCA | CD86 | CD28 | FcεRIγ |
| BCA | CD86 | CD28 | DAP10 |
| BCA | CD86 | CD28 | DAP12 |
| BCA | CD86 | CD28 | CD32 |
| BCA | CD86 | CD28 | CD79a |
| BCA | CD86 | CD28 | CD79b |
| BCA | CD86 | CD8 | CD8 |
| BCA | CD86 | CD8 | CD3ζ |
| BCA | CD86 | CD8 | CD3δ |
| BCA | CD86 | CD8 | CD3γ |
| BCA | CD86 | CD8 | CD3ε |
| BCA | CD86 | CD8 | FcγRI-γ |
| BCA | CD86 | CD8 | FcγRIII-γ |

TABLE 3-continued

Third Generation CARs

| ScFv | Co-stimulatory Signal | Co-stimulatory Signal | Signal Domain |
|---|---|---|---|
| BCA | CD86 | CD8 | FcεRIβ |
| BCA | CD86 | CD8 | FcεRIγ |
| BCA | CD86 | CD8 | DAP10 |
| BCA | CD86 | CD8 | DAP12 |
| BCA | CD86 | CD8 | CD32 |
| BCA | CD86 | CD8 | CD79a |
| BCA | CD86 | CD8 | CD79b |
| BCA | CD86 | CD4 | CD8 |
| BCA | CD86 | CD4 | CD3ζ |
| BCA | CD86 | CD4 | CD3δ |
| BCA | CD86 | CD4 | CD3γ |
| BCA | CD86 | CD4 | CD3ε |
| BCA | CD86 | CD4 | FcγRI-γ |
| BCA | CD86 | CD4 | FcγRIII-γ |
| BCA | CD86 | CD4 | FcεRIβ |
| BCA | CD86 | CD4 | FcεRIγ |
| BCA | CD86 | CD4 | DAP10 |
| BCA | CD86 | CD4 | DAP12 |
| BCA | CD86 | CD4 | CD32 |
| BCA | CD86 | CD4 | CD79a |
| BCA | CD86 | CD4 | CD79b |
| BCA | CD86 | b2c | CD8 |
| BCA | CD86 | b2c | CD3ζ |
| BCA | CD86 | b2c | CD3δ |
| BCA | CD86 | b2c | CD3γ |
| BCA | CD86 | b2c | CD3ε |
| BCA | CD86 | b2c | FcγRI-γ |
| BCA | CD86 | b2c | FcγRIII-γ |
| BCA | CD86 | b2c | FcεRIβ |
| BCA | CD86 | b2c | FcεRIγ |
| BCA | CD86 | b2c | DAP10 |
| BCA | CD86 | b2c | DAP12 |
| BCA | CD86 | b2c | CD32 |
| BCA | CD86 | b2c | CD79a |
| BCA | CD86 | b2c | CD79b |
| BCA | CD86 | CD137/41BB | CD8 |
| BCA | CD86 | CD137/41BB | CD3ζ |
| BCA | CD86 | CD137/41BB | CD3δ |
| BCA | CD86 | CD137/41BB | CD3γ |
| BCA | CD86 | CD137/41BB | CD3ε |
| BCA | CD86 | CD137/41BB | FcγRI-γ |
| BCA | CD86 | CD137/41BB | FcγRIII-γ |
| BCA | CD86 | CD137/41BB | FcεRIβ |
| BCA | CD86 | CD137/41BB | FcεRIγ |
| BCA | CD86 | CD137/41BB | DAP10 |
| BCA | CD86 | CD137/41BB | DAP12 |
| BCA | CD86 | CD137/41BB | CD32 |
| BCA | CD86 | CD137/41BB | CD79a |
| BCA | CD86 | CD137/41BB | CD79b |
| BCA | CD86 | ICOS | CD8 |
| BCA | CD86 | ICOS | CD3ζ |
| BCA | CD86 | ICOS | CD3δ |
| BCA | CD86 | ICOS | CD3γ |
| BCA | CD86 | ICOS | CD3ε |
| BCA | CD86 | ICOS | FcγRI-γ |
| BCA | CD86 | ICOS | FcγRIII-γ |
| BCA | CD86 | ICOS | FcεRIβ |
| BCA | CD86 | ICOS | FcεRIγ |
| BCA | CD86 | ICOS | DAP10 |
| BCA | CD86 | ICOS | DAP12 |
| BCA | CD86 | ICOS | CD32 |
| BCA | CD86 | ICOS | CD79a |
| BCA | CD86 | ICOS | CD79b |
| BCA | CD86 | CD27 | CD8 |
| BCA | CD86 | CD27 | CD3ζ |
| BCA | CD86 | CD27 | CD3δ |
| BCA | CD86 | CD27 | CD3γ |
| BCA | CD86 | CD27 | CD3ε |
| BCA | CD86 | CD27 | FcγRI-γ |
| BCA | CD86 | CD27 | FcγRIII-γ |
| BCA | CD86 | CD27 | FcεRIβ |
| BCA | CD86 | CD27 | FcεRIγ |
| BCA | CD86 | CD27 | DAP10 |
| BCA | CD86 | CD27 | DAP12 |
| BCA | CD86 | CD27 | CD32 |
| BCA | CD86 | CD27 | CD79a |
| BCA | CD86 | CD27 | CD79b |
| BCA | CD86 | CD28δ | CD8 |
| BCA | CD86 | CD28δ | CD3ζ |
| BCA | CD86 | CD28δ | CD3δ |
| BCA | CD86 | CD28δ | CD3γ |
| BCA | CD86 | CD28δ | CD3ε |
| BCA | CD86 | CD28δ | FcγRI-γ |
| BCA | CD86 | CD28δ | FcγRIII-γ |
| BCA | CD86 | CD28δ | FcεRIβ |
| BCA | CD86 | CD28δ | FcεRIγ |
| BCA | CD86 | CD28δ | DAP10 |
| BCA | CD86 | CD28δ | DAP12 |
| BCA | CD86 | CD28δ | CD32 |
| BCA | CD86 | CD28δ | CD79a |
| BCA | CD86 | CD28δ | CD79b |
| BCA | CD86 | CD80 | CD8 |
| BCA | CD86 | CD80 | CD3ζ |
| BCA | CD86 | CD80 | CD3δ |
| BCA | CD86 | CD80 | CD3γ |
| BCA | CD86 | CD80 | CD3ε |
| BCA | CD86 | CD80 | FcγRI-γ |
| BCA | CD86 | CD80 | FcγRIII-γ |
| BCA | CD86 | CD80 | FcεRIβ |
| BCA | CD86 | CD80 | FcεRIγ |
| BCA | CD86 | CD80 | DAP10 |
| BCA | CD86 | CD80 | DAP12 |
| BCA | CD86 | CD80 | CD32 |
| BCA | CD86 | CD80 | CD79a |
| BCA | CD86 | CD80 | CD79b |
| BCA | CD86 | CD86 | CD8 |
| BCA | CD86 | CD86 | CD3ζ |
| BCA | CD86 | CD86 | CD3δ |
| BCA | CD86 | CD86 | CD3γ |
| BCA | CD86 | CD86 | CD3ε |
| BCA | CD86 | CD86 | FcγRI-γ |
| BCA | CD86 | CD86 | FcγRIII-γ |
| BCA | CD86 | CD86 | FcεRIβ |
| BCA | CD86 | CD86 | FcεRIγ |
| BCA | CD86 | CD86 | DAP10 |
| BCA | CD86 | CD86 | DAP12 |
| BCA | CD86 | CD86 | CD32 |
| BCA | CD86 | CD86 | CD79a |
| BCA | CD86 | CD86 | CD79b |
| BCA | CD86 | OX40 | CD8 |
| BCA | CD86 | OX40 | CD3ζ |
| BCA | CD86 | OX40 | CD3δ |
| BCA | CD86 | OX40 | CD3γ |
| BCA | CD86 | OX40 | CD3ε |
| BCA | CD86 | OX40 | FcγRI-γ |
| BCA | CD86 | OX40 | FcγRIII-γ |
| BCA | CD86 | OX40 | FcεRIβ |
| BCA | CD86 | OX40 | FcεRIγ |
| BCA | CD86 | OX40 | DAP10 |
| BCA | CD86 | OX40 | DAP12 |
| BCA | CD86 | OX40 | CD32 |
| BCA | CD86 | OX40 | CD79a |
| BCA | CD86 | OX40 | CD79b |
| BCA | CD86 | DAP10 | CD8 |
| BCA | CD86 | DAP10 | CD3ζ |
| BCA | CD86 | DAP10 | CD3δ |
| BCA | CD86 | DAP10 | CD3γ |
| BCA | CD86 | DAP10 | CD3ε |
| BCA | CD86 | DAP10 | FcγRI-γ |
| BCA | CD86 | DAP10 | FcγRIII-γ |
| BCA | CD86 | DAP10 | FcεRIβ |
| BCA | CD86 | DAP10 | FcεRIγ |
| BCA | CD86 | DAP10 | DAP10 |
| BCA | CD86 | DAP10 | DAP12 |
| BCA | CD86 | DAP10 | CD32 |
| BCA | CD86 | DAP10 | CD79a |
| BCA | CD86 | DAP10 | CD79b |
| BCA | CD86 | DAP12 | CD8 |
| BCA | CD86 | DAP12 | CD3ζ |
| BCA | CD86 | DAP12 | CD3δ |

TABLE 3-continued

Third Generation CARs

| ScFv | Co-stimulatory Signal | Co-stimulatory Signal | Signal Domain |
|---|---|---|---|
| BCA | CD86 | DAP12 | CD3γ |
| BCA | CD86 | DAP12 | CD3ε |
| BCA | CD86 | DAP12 | FcγRI-γ |
| BCA | CD86 | DAP12 | FcγRIII-γ |
| BCA | CD86 | DAP12 | FcεRIβ |
| BCA | CD86 | DAP12 | FcεRIγ |
| BCA | CD86 | DAP12 | DAP10 |
| BCA | CD86 | DAP12 | DAP12 |
| BCA | CD86 | DAP12 | CD32 |
| BCA | CD86 | DAP12 | CD79a |
| BCA | CD86 | DAP12 | CD79b |
| BCA | CD86 | MyD88 | CD8 |
| BCA | CD86 | MyD88 | CD3ζ |
| BCA | CD86 | MyD88 | CD3δ |
| BCA | CD86 | MyD88 | CD3γ |
| BCA | CD86 | MyD88 | CD3ε |
| BCA | CD86 | MyD88 | FcγRI-γ |
| BCA | CD86 | MyD88 | FcγRIII-γ |
| BCA | CD86 | MyD88 | FcεRIβ |
| BCA | CD86 | MyD88 | FcεRIγ |
| BCA | CD86 | MyD88 | DAP10 |
| BCA | CD86 | MyD88 | DAP12 |
| BCA | CD86 | MyD88 | CD32 |
| BCA | CD86 | MyD88 | CD79a |
| BCA | CD86 | MyD88 | CD79b |
| BCA | CD86 | CD7 | CD8 |
| BCA | CD86 | CD7 | CD3ζ |
| BCA | CD86 | CD7 | CD3δ |
| BCA | CD86 | CD7 | CD3γ |
| BCA | CD86 | CD7 | CD3ε |
| BCA | CD86 | CD7 | FcγRI-γ |
| BCA | CD86 | CD7 | FcγRIII-γ |
| BCA | CD86 | CD7 | FcεRIβ |
| BCA | CD86 | CD7 | FcεRIγ |
| BCA | CD86 | CD7 | DAP10 |
| BCA | CD86 | CD7 | DAP12 |
| BCA | CD86 | CD7 | CD32 |
| BCA | CD86 | CD7 | CD79a |
| BCA | CD86 | CD7 | CD79b |
| BCA | CD86 | BTNL3 | CD8 |
| BCA | CD86 | BTNL3 | CD3ζ |
| BCA | CD86 | BTNL3 | CD3δ |
| BCA | CD86 | BTNL3 | CD3γ |
| BCA | CD86 | BTNL3 | CD3ε |
| BCA | CD86 | BTNL3 | FcγRI-γ |
| BCA | CD86 | BTNL3 | FcγRIII-γ |
| BCA | CD86 | BTNL3 | FcεRIβ |
| BCA | CD86 | BTNL3 | FcεRIγ |
| BCA | CD86 | BTNL3 | DAP10 |
| BCA | CD86 | BTNL3 | DAP12 |
| BCA | CD86 | BTNL3 | CD32 |
| BCA | CD86 | BTNL3 | CD79a |
| BCA | CD86 | BTNL3 | CD79b |
| BCA | CD86 | NKG2D | CD8 |
| BCA | CD86 | NKG2D | CD3ζ |
| BCA | CD86 | NKG2D | CD3δ |
| BCA | CD86 | NKG2D | CD3γ |
| BCA | CD86 | NKG2D | CD3ε |
| BCA | CD86 | NKG2D | FcγRI-γ |
| BCA | CD86 | NKG2D | FcγRIII-γ |
| BCA | CD86 | NKG2D | FcεRIβ |
| BCA | CD86 | NKG2D | FcεRIγ |
| BCA | CD86 | NKG2D | DAP10 |
| BCA | CD86 | NKG2D | DAP12 |
| BCA | CD86 | NKG2D | CD32 |
| BCA | CD86 | NKG2D | CD79a |
| BCA | CD86 | NKG2D | CD79b |
| BCA | OX40 | CD28 | CD8 |
| BCA | OX40 | CD28 | CD3ζ |
| BCA | OX40 | CD28 | CD3δ |
| BCA | OX40 | CD28 | CD3γ |
| BCA | OX40 | CD28 | CD3ε |
| BCA | OX40 | CD28 | FcγRI-γ |
| BCA | OX40 | CD28 | FcγRIII-γ |
| BCA | OX40 | CD28 | FcεRIβ |
| BCA | OX40 | CD28 | FcεRIγ |
| BCA | OX40 | CD28 | DAP10 |
| BCA | OX40 | CD28 | DAP12 |
| BCA | OX40 | CD28 | CD32 |
| BCA | OX40 | CD28 | CD79a |
| BCA | OX40 | CD28 | CD79b |
| BCA | OX40 | CD8 | CD8 |
| BCA | OX40 | CD8 | CD3ζ |
| BCA | OX40 | CD8 | CD3δ |
| BCA | OX40 | CD8 | CD3γ |
| BCA | OX40 | CD8 | CD3ε |
| BCA | OX40 | CD8 | FcγRI-γ |
| BCA | OX40 | CD8 | FcγRIII-γ |
| BCA | OX40 | CD8 | FcεRIβ |
| BCA | OX40 | CD8 | FcεRIγ |
| BCA | OX40 | CD8 | DAP10 |
| BCA | OX40 | CD8 | DAP12 |
| BCA | OX40 | CD8 | CD32 |
| BCA | OX40 | CD8 | CD79a |
| BCA | OX40 | CD8 | CD79b |
| BCA | OX40 | CD4 | CD8 |
| BCA | OX40 | CD4 | CD3ζ |
| BCA | OX40 | CD4 | CD3δ |
| BCA | OX40 | CD4 | CD3γ |
| BCA | OX40 | CD4 | CD3ε |
| BCA | OX40 | CD4 | FcγRI-γ |
| BCA | OX40 | CD4 | FcγRIII-γ |
| BCA | OX40 | CD4 | FcεRIβ |
| BCA | OX40 | CD4 | FcεRIγ |
| BCA | OX40 | CD4 | DAP10 |
| BCA | OX40 | CD4 | DAP12 |
| BCA | OX40 | CD4 | CD32 |
| BCA | OX40 | CD4 | CD79a |
| BCA | OX40 | CD4 | CD79b |
| BCA | OX40 | b2c | CD8 |
| BCA | OX40 | b2c | CD3ζ |
| BCA | OX40 | b2c | CD3δ |
| BCA | OX40 | b2c | CD3γ |
| BCA | OX40 | b2c | CD3ε |
| BCA | OX40 | b2c | FcγRI-γ |
| BCA | OX40 | b2c | FcγRIII-γ |
| BCA | OX40 | b2c | FcεRIβ |
| BCA | OX40 | b2c | FcεRIγ |
| BCA | OX40 | b2c | DAP10 |
| BCA | OX40 | b2c | DAP12 |
| BCA | OX40 | b2c | CD32 |
| BCA | OX40 | b2c | CD79a |
| BCA | OX40 | b2c | CD79b |
| BCA | OX40 | CD137/41BB | CD8 |
| BCA | OX40 | CD137/41BB | CD3ζ |
| BCA | OX40 | CD137/41BB | CD3δ |
| BCA | OX40 | CD137/41BB | CD3γ |
| BCA | OX40 | CD137/41BB | CD3ε |
| BCA | OX40 | CD137/41BB | FcγRI-γ |
| BCA | OX40 | CD137/41BB | FcγRIII-γ |
| BCA | OX40 | CD137/41BB | FcεRIβ |
| BCA | OX40 | CD137/41BB | FcεRIγ |
| BCA | OX40 | CD137/41BB | DAP10 |
| BCA | OX40 | CD137/41BB | DAP12 |
| BCA | OX40 | CD137/41BB | CD32 |
| BCA | OX40 | CD137/41BB | CD79a |
| BCA | OX40 | CD137/41BB | CD79b |
| BCA | OX40 | ICOS | CD8 |
| BCA | OX40 | ICOS | CD3ζ |
| BCA | OX40 | ICOS | CD3δ |
| BCA | OX40 | ICOS | CD3γ |
| BCA | OX40 | ICOS | CD3ε |
| BCA | OX40 | ICOS | FcγRI-γ |
| BCA | OX40 | ICOS | FcγRIII-γ |
| BCA | OX40 | ICOS | FcεRIβ |
| BCA | OX40 | ICOS | FcεRIγ |
| BCA | OX40 | ICOS | DAP10 |
| BCA | OX40 | ICOS | DAP12 |
| BCA | OX40 | ICOS | CD32 |
| BCA | OX40 | ICOS | CD79a |

TABLE 3-continued

Third Generation CARs

| ScFv | Co-stimulatory Signal | Co-stimulatory Signal | Signal Domain |
|---|---|---|---|
| BCA | OX40 | ICOS | CD79b |
| BCA | OX40 | CD27 | CD8 |
| BCA | OX40 | CD27 | CD3ζ |
| BCA | OX40 | CD27 | CD3δ |
| BCA | OX40 | CD27 | CD3γ |
| BCA | OX40 | CD27 | CD3ε |
| BCA | OX40 | CD27 | FcγRI-γ |
| BCA | OX40 | CD27 | FcγRIII-γ |
| BCA | OX40 | CD27 | FcεRIβ |
| BCA | OX40 | CD27 | FcεRIγ |
| BCA | OX40 | CD27 | DAP10 |
| BCA | OX40 | CD27 | DAP12 |
| BCA | OX40 | CD27 | CD32 |
| BCA | OX40 | CD27 | CD79a |
| BCA | OX40 | CD27 | CD79b |
| BCA | OX40 | CD28δ | CD8 |
| BCA | OX40 | CD28δ | CD3ζ |
| BCA | OX40 | CD28δ | CD3δ |
| BCA | OX40 | CD28δ | CD3γ |
| BCA | OX40 | CD28δ | CD3ε |
| BCA | OX40 | CD28δ | FcγRI-γ |
| BCA | OX40 | CD28δ | FcγRIII-γ |
| BCA | OX40 | CD28δ | FcεRIβ |
| BCA | OX40 | CD28δ | FcεRIγ |
| BCA | OX40 | CD28δ | DAP10 |
| BCA | OX40 | CD28δ | DAP12 |
| BCA | OX40 | CD28δ | CD32 |
| BCA | OX40 | CD28δ | CD79a |
| BCA | OX40 | CD28δ | CD79b |
| BCA | OX40 | CD80 | CD8 |
| BCA | OX40 | CD80 | CD3ζ |
| BCA | OX40 | CD80 | CD3δ |
| BCA | OX40 | CD80 | CD3γ |
| BCA | OX40 | CD80 | CD3ε |
| BCA | OX40 | CD80 | FcγRI-γ |
| BCA | OX40 | CD80 | FcγRIII-γ |
| BCA | OX40 | CD80 | FcεRIβ |
| BCA | OX40 | CD80 | FcεRIγ |
| BCA | OX40 | CD80 | DAP10 |
| BCA | OX40 | CD80 | DAP12 |
| BCA | OX40 | CD80 | CD32 |
| BCA | OX40 | CD80 | CD79a |
| BCA | OX40 | CD80 | CD79b |
| BCA | OX40 | CD86 | CD8 |
| BCA | OX40 | CD86 | CD3ζ |
| BCA | OX40 | CD86 | CD3δ |
| BCA | OX40 | CD86 | CD3γ |
| BCA | OX40 | CD86 | CD3ε |
| BCA | OX40 | CD86 | FcγRI-γ |
| BCA | OX40 | CD86 | FcγRIII-γ |
| BCA | OX40 | CD86 | FcεRIβ |
| BCA | OX40 | CD86 | FcεRIγ |
| BCA | OX40 | CD86 | DAP10 |
| BCA | OX40 | CD86 | DAP12 |
| BCA | OX40 | CD86 | CD32 |
| BCA | OX40 | CD86 | CD79a |
| BCA | OX40 | CD86 | CD79b |
| BCA | OX40 | OX40 | CD8 |
| BCA | OX40 | OX40 | CD3ζ |
| BCA | OX40 | OX40 | CD3δ |
| BCA | OX40 | OX40 | CD3γ |
| BCA | OX40 | OX40 | CD3ε |
| BCA | OX40 | OX40 | FcγRI-γ |
| BCA | OX40 | OX40 | FcγRIII-γ |
| BCA | OX40 | OX40 | FcεRIβ |
| BCA | OX40 | OX40 | FcεRIγ |
| BCA | OX40 | OX40 | DAP10 |
| BCA | OX40 | OX40 | DAP12 |
| BCA | OX40 | OX40 | CD32 |
| BCA | OX40 | OX40 | CD79a |
| BCA | OX40 | OX40 | CD79b |
| BCA | OX40 | DAP10 | CD8 |
| BCA | OX40 | DAP10 | CD3ζ |
| BCA | OX40 | DAP10 | CD3δ |
| BCA | OX40 | DAP10 | CD3γ |
| BCA | OX40 | DAP10 | CD3ε |
| BCA | OX40 | DAP10 | FcγRI-γ |
| BCA | OX40 | DAP10 | FcγRIII-γ |
| BCA | OX40 | DAP10 | FcεRIβ |
| BCA | OX40 | DAP10 | FcεRIγ |
| BCA | OX40 | DAP10 | DAP10 |
| BCA | OX40 | DAP10 | DAP12 |
| BCA | OX40 | DAP10 | CD32 |
| BCA | OX40 | DAP10 | CD79a |
| BCA | OX40 | DAP10 | CD79b |
| BCA | OX40 | DAP12 | CD8 |
| BCA | OX40 | DAP12 | CD3ζ |
| BCA | OX40 | DAP12 | CD3δ |
| BCA | OX40 | DAP12 | CD3γ |
| BCA | OX40 | DAP12 | CD3ε |
| BCA | OX40 | DAP12 | FcγRI-γ |
| BCA | OX40 | DAP12 | FcγRIII-γ |
| BCA | OX40 | DAP12 | FcεRIβ |
| BCA | OX40 | DAP12 | FcεRIγ |
| BCA | OX40 | DAP12 | DAP10 |
| BCA | OX40 | DAP12 | DAP12 |
| BCA | OX40 | DAP12 | CD32 |
| BCA | OX40 | DAP12 | CD79a |
| BCA | OX40 | DAP12 | CD79b |
| BCA | OX40 | MyD88 | CD8 |
| BCA | OX40 | MyD88 | CD3ζ |
| BCA | OX40 | MyD88 | CD3δ |
| BCA | OX40 | MyD88 | CD3γ |
| BCA | OX40 | MyD88 | CD3ε |
| BCA | OX40 | MyD88 | FcγRI-γ |
| BCA | OX40 | MyD88 | FcγRIII-γ |
| BCA | OX40 | MyD88 | FcεRIβ |
| BCA | OX40 | MyD88 | FcεRIγ |
| BCA | OX40 | MyD88 | DAP10 |
| BCA | OX40 | MyD88 | DAP12 |
| BCA | OX40 | MyD88 | CD32 |
| BCA | OX40 | MyD88 | CD79a |
| BCA | OX40 | MyD88 | CD79b |
| BCA | OX40 | CD7 | CD8 |
| BCA | OX40 | CD7 | CD3ζ |
| BCA | OX40 | CD7 | CD3δ |
| BCA | OX40 | CD7 | CD3γ |
| BCA | OX40 | CD7 | CD3ε |
| BCA | OX40 | CD7 | FcγRI-γ |
| BCA | OX40 | CD7 | FcγRIII-γ |
| BCA | OX40 | CD7 | FcεRIβ |
| BCA | OX40 | CD7 | FcεRIγ |
| BCA | OX40 | CD7 | DAP10 |
| BCA | OX40 | CD7 | DAP12 |
| BCA | OX40 | CD7 | CD32 |
| BCA | OX40 | CD7 | CD79a |
| BCA | OX40 | CD7 | CD79b |
| BCA | OX40 | BTNL3 | CD8 |
| BCA | OX40 | BTNL3 | CD3ζ |
| BCA | OX40 | BTNL3 | CD3δ |
| BCA | OX40 | BTNL3 | CD3γ |
| BCA | OX40 | BTNL3 | CD3ε |
| BCA | OX40 | BTNL3 | FcγRI-γ |
| BCA | OX40 | BTNL3 | FcγRIII-γ |
| BCA | OX40 | BTNL3 | FcεRIβ |
| BCA | OX40 | BTNL3 | FcεRIγ |
| BCA | OX40 | BTNL3 | DAP10 |
| BCA | OX40 | BTNL3 | DAP12 |
| BCA | OX40 | BTNL3 | CD32 |
| BCA | OX40 | BTNL3 | CD79a |
| BCA | OX40 | BTNL3 | CD79b |
| BCA | OX40 | NKG2D | CD8 |
| BCA | OX40 | NKG2D | CD3ζ |
| BCA | OX40 | NKG2D | CD3δ |
| BCA | OX40 | NKG2D | CD3γ |
| BCA | OX40 | NKG2D | CD3ε |
| BCA | OX40 | NKG2D | FcγRI-γ |
| BCA | OX40 | NKG2D | FcγRIII-γ |
| BCA | OX40 | NKG2D | FcεRIβ |
| BCA | OX40 | NKG2D | FcεRIγ |

TABLE 3-continued

Third Generation CARs

| ScFv | Co-stimulatory Signal | Co-stimulatory Signal | Signal Domain |
|---|---|---|---|
| BCA | OX40 | NKG2D | DAP10 |
| BCA | OX40 | NKG2D | DAP12 |
| BCA | OX40 | NKG2D | CD32 |
| BCA | OX40 | NKG2D | CD79a |
| BCA | OX40 | NKG2D | CD79b |
| BCA | DAP10 | CD28 | CD8 |
| BCA | DAP10 | CD28 | CD3ζ |
| BCA | DAP10 | CD28 | CD3δ |
| BCA | DAP10 | CD28 | CD3γ |
| BCA | DAP10 | CD28 | CD3ε |
| BCA | DAP10 | CD28 | FcγRI-γ |
| BCA | DAP10 | CD28 | FcγRIII-γ |
| BCA | DAP10 | CD28 | FcεRIβ |
| BCA | DAP10 | CD28 | FcεRIγ |
| BCA | DAP10 | CD28 | DAP10 |
| BCA | DAP10 | CD28 | DAP12 |
| BCA | DAP10 | CD28 | CD32 |
| BCA | DAP10 | CD28 | CD79a |
| BCA | DAP10 | CD28 | CD79b |
| BCA | DAP10 | CD8 | CD8 |
| BCA | DAP10 | CD8 | CD3ζ |
| BCA | DAP10 | CD8 | CD3δ |
| BCA | DAP10 | CD8 | CD3γ |
| BCA | DAP10 | CD8 | CD3ε |
| BCA | DAP10 | CD8 | FcγRI-γ |
| BCA | DAP10 | CD8 | FcγRIII-γ |
| BCA | DAP10 | CD8 | FcεRIβ |
| BCA | DAP10 | CD8 | FcεRIγ |
| BCA | DAP10 | CD8 | DAP10 |
| BCA | DAP10 | CD8 | DAP12 |
| BCA | DAP10 | CD8 | CD32 |
| BCA | DAP10 | CD8 | CD79a |
| BCA | DAP10 | CD8 | CD79b |
| BCA | DAP10 | CD4 | CD8 |
| BCA | DAP10 | CD4 | CD3ζ |
| BCA | DAP10 | CD4 | CD3δ |
| BCA | DAP10 | CD4 | CD3γ |
| BCA | DAP10 | CD4 | CD3ε |
| BCA | DAP10 | CD4 | FcγRI-γ |
| BCA | DAP10 | CD4 | FcγRIII-γ |
| BCA | DAP10 | CD4 | FcεRIβ |
| BCA | DAP10 | CD4 | FcεRIγ |
| BCA | DAP10 | CD4 | DAP10 |
| BCA | DAP10 | CD4 | DAP12 |
| BCA | DAP10 | CD4 | CD32 |
| BCA | DAP10 | CD4 | CD79a |
| BCA | DAP10 | CD4 | CD79b |
| BCA | DAP10 | b2c | CD8 |
| BCA | DAP10 | b2c | CD3ζ |
| BCA | DAP10 | b2c | CD3δ |
| BCA | DAP10 | b2c | CD3γ |
| BCA | DAP10 | b2c | CD3ε |
| BCA | DAP10 | b2c | FcγRI-γ |
| BCA | DAP10 | b2c | FcγRIII-γ |
| BCA | DAP10 | b2c | FcεRIβ |
| BCA | DAP10 | b2c | FcεRIγ |
| BCA | DAP10 | b2c | DAP10 |
| BCA | DAP10 | b2c | DAP12 |
| BCA | DAP10 | b2c | CD32 |
| BCA | DAP10 | b2c | CD79a |
| BCA | DAP10 | b2c | CD79b |
| BCA | DAP10 | CD137/41BB | CD8 |
| BCA | DAP10 | CD137/41BB | CD3ζ |
| BCA | DAP10 | CD137/41BB | CD3δ |
| BCA | DAP10 | CD137/41BB | CD3γ |
| BCA | DAP10 | CD137/41BB | CD3ε |
| BCA | DAP10 | CD137/41BB | FcγRI-γ |
| BCA | DAP10 | CD137/41BB | FcγRIII-γ |
| BCA | DAP10 | CD137/41BB | FcεRIβ |
| BCA | DAP10 | CD137/41BB | FcεRIγ |
| BCA | DAP10 | CD137/41BB | DAP10 |
| BCA | DAP10 | CD137/41BB | DAP12 |
| BCA | DAP10 | CD137/41BB | CD32 |
| BCA | DAP10 | CD137/41BB | CD79a |
| BCA | DAP10 | CD137/41BB | CD79b |
| BCA | DAP10 | ICOS | CD8 |
| BCA | DAP10 | ICOS | CD3ζ |
| BCA | DAP10 | ICOS | CD3δ |
| BCA | DAP10 | ICOS | CD3γ |
| BCA | DAP10 | ICOS | CD3ε |
| BCA | DAP10 | ICOS | FcγRI-γ |
| BCA | DAP10 | ICOS | FcγRIII-γ |
| BCA | DAP10 | ICOS | FcεRIβ |
| BCA | DAP10 | ICOS | FcεRIγ |
| BCA | DAP10 | ICOS | DAP10 |
| BCA | DAP10 | ICOS | DAP12 |
| BCA | DAP10 | ICOS | CD32 |
| BCA | DAP10 | ICOS | CD79a |
| BCA | DAP10 | ICOS | CD79b |
| BCA | DAP10 | CD27 | CD8 |
| BCA | DAP10 | CD27 | CD3ζ |
| BCA | DAP10 | CD27 | CD3δ |
| BCA | DAP10 | CD27 | CD3γ |
| BCA | DAP10 | CD27 | CD3ε |
| BCA | DAP10 | CD27 | FcγRI-γ |
| BCA | DAP10 | CD27 | FcγRIII-γ |
| BCA | DAP10 | CD27 | FcεRIβ |
| BCA | DAP10 | CD27 | FcεRIγ |
| BCA | DAP10 | CD27 | DAP10 |
| BCA | DAP10 | CD27 | DAP12 |
| BCA | DAP10 | CD27 | CD32 |
| BCA | DAP10 | CD27 | CD79a |
| BCA | DAP10 | CD27 | CD79b |
| BCA | DAP10 | CD28δ | CD8 |
| BCA | DAP10 | CD28δ | CD3ζ |
| BCA | DAP10 | CD28δ | CD3δ |
| BCA | DAP10 | CD28δ | CD3γ |
| BCA | DAP10 | CD28δ | CD3ε |
| BCA | DAP10 | CD28δ | FcγRI-γ |
| BCA | DAP10 | CD28δ | FcγRIII-γ |
| BCA | DAP10 | CD28δ | FcεRIβ |
| BCA | DAP10 | CD28δ | FcεRIγ |
| BCA | DAP10 | CD28δ | DAP10 |
| BCA | DAP10 | CD28δ | DAP12 |
| BCA | DAP10 | CD28δ | CD32 |
| BCA | DAP10 | CD28δ | CD79a |
| BCA | DAP10 | CD28δ | CD79b |
| BCA | DAP10 | CD80 | CD8 |
| BCA | DAP10 | CD80 | CD3ζ |
| BCA | DAP10 | CD80 | CD3δ |
| BCA | DAP10 | CD80 | CD3γ |
| BCA | DAP10 | CD80 | CD3ε |
| BCA | DAP10 | CD80 | FcγRI-γ |
| BCA | DAP10 | CD80 | FcγRIII-γ |
| BCA | DAP10 | CD80 | FcεRIβ |
| BCA | DAP10 | CD80 | FcεRIγ |
| BCA | DAP10 | CD80 | DAP10 |
| BCA | DAP10 | CD80 | DAP12 |
| BCA | DAP10 | CD80 | CD32 |
| BCA | DAP10 | CD80 | CD79a |
| BCA | DAP10 | CD80 | CD79b |
| BCA | DAP10 | CD86 | CD8 |
| BCA | DAP10 | CD86 | CD3ζ |
| BCA | DAP10 | CD86 | CD3δ |
| BCA | DAP10 | CD86 | CD3γ |
| BCA | DAP10 | CD86 | CD3ε |
| BCA | DAP10 | CD86 | FcγRI-γ |
| BCA | DAP10 | CD86 | FcγRIII-γ |
| BCA | DAP10 | CD86 | FcεRIβ |
| BCA | DAP10 | CD86 | FcεRIγ |
| BCA | DAP10 | CD86 | DAP10 |
| BCA | DAP10 | CD86 | DAP12 |
| BCA | DAP10 | CD86 | CD32 |
| BCA | DAP10 | CD86 | CD79a |
| BCA | DAP10 | CD86 | CD79b |
| BCA | DAP10 | OX40 | CD8 |
| BCA | DAP10 | OX40 | CD3ζ |
| BCA | DAP10 | OX40 | CD3δ |
| BCA | DAP10 | OX40 | CD3γ |
| BCA | DAP10 | OX40 | CD3ε |

TABLE 3-continued

Third Generation CARs

| ScFv | Co-stimulatory Signal | Co-stimulatory Signal | Signal Domain |
| --- | --- | --- | --- |
| BCA | DAP10 | OX40 | FcγRI-γ |
| BCA | DAP10 | OX40 | FcγRIII-γ |
| BCA | DAP10 | OX40 | FcεRIβ |
| BCA | DAP10 | OX40 | FcεRIγ |
| BCA | DAP10 | OX40 | DAP10 |
| BCA | DAP10 | OX40 | DAP12 |
| BCA | DAP10 | OX40 | CD32 |
| BCA | DAP10 | OX40 | CD79a |
| BCA | DAP10 | OX40 | CD79b |
| BCA | DAP10 | DAP10 | CD8 |
| BCA | DAP10 | DAP10 | CD3ζ |
| BCA | DAP10 | DAP10 | CD3δ |
| BCA | DAP10 | DAP10 | CD3γ |
| BCA | DAP10 | DAP10 | CD3ε |
| BCA | DAP10 | DAP10 | FcγRI-γ |
| BCA | DAP10 | DAP10 | FcγRIII-γ |
| BCA | DAP10 | DAP10 | FcεRIβ |
| BCA | DAP10 | DAP10 | FcεRIγ |
| BCA | DAP10 | DAP10 | DAP10 |
| BCA | DAP10 | DAP10 | DAP12 |
| BCA | DAP10 | DAP10 | CD32 |
| BCA | DAP10 | DAP10 | CD79a |
| BCA | DAP10 | DAP10 | CD79b |
| BCA | DAP10 | DAP12 | CD8 |
| BCA | DAP10 | DAP12 | CD3ζ |
| BCA | DAP10 | DAP12 | CD3δ |
| BCA | DAP10 | DAP12 | CD3γ |
| BCA | DAP10 | DAP12 | CD3ε |
| BCA | DAP10 | DAP12 | FcγRI-γ |
| BCA | DAP10 | DAP12 | FcγRIII-γ |
| BCA | DAP10 | DAP12 | FcεRIβ |
| BCA | DAP10 | DAP12 | FcεRIγ |
| BCA | DAP10 | DAP12 | DAP10 |
| BCA | DAP10 | DAP12 | DAP12 |
| BCA | DAP10 | DAP12 | CD32 |
| BCA | DAP10 | DAP12 | CD79a |
| BCA | DAP10 | DAP12 | CD79b |
| BCA | DAP10 | MyD88 | CD8 |
| BCA | DAP10 | MyD88 | CD3ζ |
| BCA | DAP10 | MyD88 | CD3δ |
| BCA | DAP10 | MyD88 | CD3γ |
| BCA | DAP10 | MyD88 | CD3ε |
| BCA | DAP10 | MyD88 | FcγRI-γ |
| BCA | DAP10 | MyD88 | FcγRIII-γ |
| BCA | DAP10 | MyD88 | FcεRIβ |
| BCA | DAP10 | MyD88 | FcεRIγ |
| BCA | DAP10 | MyD88 | DAP10 |
| BCA | DAP10 | MyD88 | DAP12 |
| BCA | DAP10 | MyD88 | CD32 |
| BCA | DAP10 | MyD88 | CD79a |
| BCA | DAP10 | MyD88 | CD79b |
| BCA | DAP10 | CD7 | CD8 |
| BCA | DAP10 | CD7 | CD3ζ |
| BCA | DAP10 | CD7 | CD3δ |
| BCA | DAP10 | CD7 | CD3γ |
| BCA | DAP10 | CD7 | CD3ε |
| BCA | DAP10 | CD7 | FcγRI-γ |
| BCA | DAP10 | CD7 | FcγRIII-γ |
| BCA | DAP10 | CD7 | FcεRIβ |
| BCA | DAP10 | CD7 | FcεRIγ |
| BCA | DAP10 | CD7 | DAP10 |
| BCA | DAP10 | CD7 | DAP12 |
| BCA | DAP10 | CD7 | CD32 |
| BCA | DAP10 | CD7 | CD79a |
| BCA | DAP10 | CD7 | CD79b |
| BCA | DAP10 | BTNL3 | CD8 |
| BCA | DAP10 | BTNL3 | CD3ζ |
| BCA | DAP10 | BTNL3 | CD3δ |
| BCA | DAP10 | BTNL3 | CD3γ |
| BCA | DAP10 | BTNL3 | CD3ε |
| BCA | DAP10 | BTNL3 | FcγRI-γ |
| BCA | DAP10 | BTNL3 | FcγRIII-γ |
| BCA | DAP10 | BTNL3 | FcεRIβ |
| BCA | DAP10 | BTNL3 | FcεRIγ |
| BCA | DAP10 | BTNL3 | DAP10 |
| BCA | DAP10 | BTNL3 | DAP12 |
| BCA | DAP10 | BTNL3 | CD32 |
| BCA | DAP10 | BTNL3 | CD79a |
| BCA | DAP10 | BTNL3 | CD79b |
| BCA | DAP10 | NKG2D | CD8 |
| BCA | DAP10 | NKG2D | CD3ζ |
| BCA | DAP10 | NKG2D | CD3δ |
| BCA | DAP10 | NKG2D | CD3γ |
| BCA | DAP10 | NKG2D | CD3ε |
| BCA | DAP10 | NKG2D | FcγRI-γ |
| BCA | DAP10 | NKG2D | FcγRIII-γ |
| BCA | DAP10 | NKG2D | FcεRIβ |
| BCA | DAP10 | NKG2D | FcεRIγ |
| BCA | DAP10 | NKG2D | DAP10 |
| BCA | DAP10 | NKG2D | DAP12 |
| BCA | DAP10 | NKG2D | CD32 |
| BCA | DAP10 | NKG2D | CD79a |
| BCA | DAP10 | NKG2D | CD79b |
| BCA | DAP12 | CD28 | CD8 |
| BCA | DAP12 | CD28 | CD3ζ |
| BCA | DAP12 | CD28 | CD3δ |
| BCA | DAP12 | CD28 | CD3γ |
| BCA | DAP12 | CD28 | CD3ε |
| BCA | DAP12 | CD28 | FcγRI-γ |
| BCA | DAP12 | CD28 | FcγRIII-γ |
| BCA | DAP12 | CD28 | FcεRIβ |
| BCA | DAP12 | CD28 | FcεRIγ |
| BCA | DAP12 | CD28 | DAP10 |
| BCA | DAP12 | CD28 | DAP12 |
| BCA | DAP12 | CD28 | CD32 |
| BCA | DAP12 | CD28 | CD79a |
| BCA | DAP12 | CD28 | CD79b |
| BCA | DAP12 | CD8 | CD8 |
| BCA | DAP12 | CD8 | CD3ζ |
| BCA | DAP12 | CD8 | CD3δ |
| BCA | DAP12 | CD8 | CD3γ |
| BCA | DAP12 | CD8 | CD3ε |
| BCA | DAP12 | CD8 | FcγRI-γ |
| BCA | DAP12 | CD8 | FcγRIII-γ |
| BCA | DAP12 | CD8 | FcεRIβ |
| BCA | DAP12 | CD8 | FcεRIγ |
| BCA | DAP12 | CD8 | DAP10 |
| BCA | DAP12 | CD8 | DAP12 |
| BCA | DAP12 | CD8 | CD32 |
| BCA | DAP12 | CD8 | CD79a |
| BCA | DAP12 | CD8 | CD79b |
| BCA | DAP12 | CD4 | CD8 |
| BCA | DAP12 | CD4 | CD3ζ |
| BCA | DAP12 | CD4 | CD3δ |
| BCA | DAP12 | CD4 | CD3γ |
| BCA | DAP12 | CD4 | CD3ε |
| BCA | DAP12 | CD4 | FcγRI-γ |
| BCA | DAP12 | CD4 | FcγRIII-γ |
| BCA | DAP12 | CD4 | FcεRIβ |
| BCA | DAP12 | CD4 | FcεRIγ |
| BCA | DAP12 | CD4 | DAP10 |
| BCA | DAP12 | CD4 | DAP12 |
| BCA | DAP12 | CD4 | CD32 |
| BCA | DAP12 | CD4 | CD79a |
| BCA | DAP12 | CD4 | CD79b |
| BCA | DAP12 | b2c | CD8 |
| BCA | DAP12 | b2c | CD3ζ |
| BCA | DAP12 | b2c | CD3δ |
| BCA | DAP12 | b2c | CD3γ |
| BCA | DAP12 | b2c | CD3ε |
| BCA | DAP12 | b2c | FcγRI-γ |
| BCA | DAP12 | b2c | FcγRIII-γ |
| BCA | DAP12 | b2c | FcεRIβ |
| BCA | DAP12 | b2c | FcεRIγ |
| BCA | DAP12 | b2c | DAP10 |
| BCA | DAP12 | b2c | DAP12 |
| BCA | DAP12 | b2c | CD32 |
| BCA | DAP12 | b2c | CD79a |
| BCA | DAP12 | b2c | CD79b |
| BCA | DAP12 | CD137/41BB | CD8 |

TABLE 3-continued

Third Generation CARs

| ScFv | Co-stimulatory Signal | Co-stimulatory Signal | Signal Domain |
|---|---|---|---|
| BCA | DAP12 | CD137/41BB | CD3ζ |
| BCA | DAP12 | CD137/41BB | CD3δ |
| BCA | DAP12 | CD137/41BB | CD3γ |
| BCA | DAP12 | CD137/41BB | CD3ε |
| BCA | DAP12 | CD137/41BB | FcγRI-γ |
| BCA | DAP12 | CD137/41BB | FcγRIII-γ |
| BCA | DAP12 | CD137/41BB | FcεRIβ |
| BCA | DAP12 | CD137/41BB | FcεRIγ |
| BCA | DAP12 | CD137/41BB | DAP10 |
| BCA | DAP12 | CD137/41BB | DAP12 |
| BCA | DAP12 | CD137/41BB | CD32 |
| BCA | DAP12 | CD137/41BB | CD79a |
| BCA | DAP12 | CD137/41BB | CD79b |
| BCA | DAP12 | ICOS | CD8 |
| BCA | DAP12 | ICOS | CD3ζ |
| BCA | DAP12 | ICOS | CD3δ |
| BCA | DAP12 | ICOS | CD3γ |
| BCA | DAP12 | ICOS | CD3ε |
| BCA | DAP12 | ICOS | FcγRI-γ |
| BCA | DAP12 | ICOS | FcγRIII-γ |
| BCA | DAP12 | ICOS | FcεRIβ |
| BCA | DAP12 | ICOS | FcεRIγ |
| BCA | DAP12 | ICOS | DAP10 |
| BCA | DAP12 | ICOS | DAP12 |
| BCA | DAP12 | ICOS | CD32 |
| BCA | DAP12 | ICOS | CD79a |
| BCA | DAP12 | ICOS | CD79b |
| BCA | DAP12 | CD27 | CD8 |
| BCA | DAP12 | CD27 | CD3ζ |
| BCA | DAP12 | CD27 | CD3δ |
| BCA | DAP12 | CD27 | CD3γ |
| BCA | DAP12 | CD27 | CD3ε |
| BCA | DAP12 | CD27 | FcγRI-γ |
| BCA | DAP12 | CD27 | FcγRIII-γ |
| BCA | DAP12 | CD27 | FcεRIβ |
| BCA | DAP12 | CD27 | FcεRIγ |
| BCA | DAP12 | CD27 | DAP10 |
| BCA | DAP12 | CD27 | DAP12 |
| BCA | DAP12 | CD27 | CD32 |
| BCA | DAP12 | CD27 | CD79a |
| BCA | DAP12 | CD27 | CD79b |
| BCA | DAP12 | CD28δ | CD8 |
| BCA | DAP12 | CD28δ | CD3ζ |
| BCA | DAP12 | CD28δ | CD3δ |
| BCA | DAP12 | CD28δ | CD3γ |
| BCA | DAP12 | CD28δ | CD3ε |
| BCA | DAP12 | CD28δ | FcγRI-γ |
| BCA | DAP12 | CD28δ | FcγRIII-γ |
| BCA | DAP12 | CD28δ | FcεRIβ |
| BCA | DAP12 | CD28δ | FcεRIγ |
| BCA | DAP12 | CD28δ | DAP10 |
| BCA | DAP12 | CD28δ | DAP12 |
| BCA | DAP12 | CD28δ | CD32 |
| BCA | DAP12 | CD28δ | CD79a |
| BCA | DAP12 | CD28δ | CD79b |
| BCA | DAP12 | CD80 | CD8 |
| BCA | DAP12 | CD80 | CD3ζ |
| BCA | DAP12 | CD80 | CD3δ |
| BCA | DAP12 | CD80 | CD3γ |
| BCA | DAP12 | CD80 | CD3ε |
| BCA | DAP12 | CD80 | FcγRI-γ |
| BCA | DAP12 | CD80 | FcγRIII-γ |
| BCA | DAP12 | CD80 | FcεRIβ |
| BCA | DAP12 | CD80 | FcεRIγ |
| BCA | DAP12 | CD80 | DAP10 |
| BCA | DAP12 | CD80 | DAP12 |
| BCA | DAP12 | CD80 | CD32 |
| BCA | DAP12 | CD80 | CD79a |
| BCA | DAP12 | CD80 | CD79b |
| BCA | DAP12 | CD86 | CD8 |
| BCA | DAP12 | CD86 | CD3ζ |
| BCA | DAP12 | CD86 | CD3δ |
| BCA | DAP12 | CD86 | CD3γ |
| BCA | DAP12 | CD86 | CD3ε |
| BCA | DAP12 | CD86 | FcγRI-γ |
| BCA | DAP12 | CD86 | FcγRIII-γ |
| BCA | DAP12 | CD86 | FcεRIβ |
| BCA | DAP12 | CD86 | FcεRIγ |
| BCA | DAP12 | CD86 | DAP10 |
| BCA | DAP12 | CD86 | DAP12 |
| BCA | DAP12 | CD86 | CD32 |
| BCA | DAP12 | CD86 | CD79a |
| BCA | DAP12 | CD86 | CD79b |
| BCA | DAP12 | OX40 | CD8 |
| BCA | DAP12 | OX40 | CD3ζ |
| BCA | DAP12 | OX40 | CD3δ |
| BCA | DAP12 | OX40 | CD3γ |
| BCA | DAP12 | OX40 | CD3ε |
| BCA | DAP12 | OX40 | FcγRI-γ |
| BCA | DAP12 | OX40 | FcγRIII-γ |
| BCA | DAP12 | OX40 | FcεRIβ |
| BCA | DAP12 | OX40 | FcεRIγ |
| BCA | DAP12 | OX40 | DAP10 |
| BCA | DAP12 | OX40 | DAP12 |
| BCA | DAP12 | OX40 | CD32 |
| BCA | DAP12 | OX40 | CD79a |
| BCA | DAP12 | OX40 | CD79b |
| BCA | DAP12 | DAP10 | CD8 |
| BCA | DAP12 | DAP10 | CD3ζ |
| BCA | DAP12 | DAP10 | CD3δ |
| BCA | DAP12 | DAP10 | CD3γ |
| BCA | DAP12 | DAP10 | CD3ε |
| BCA | DAP12 | DAP10 | FcγRI-γ |
| BCA | DAP12 | DAP10 | FcγRIII-γ |
| BCA | DAP12 | DAP10 | FcεRIβ |
| BCA | DAP12 | DAP10 | FcεRIγ |
| BCA | DAP12 | DAP10 | DAP10 |
| BCA | DAP12 | DAP10 | DAP12 |
| BCA | DAP12 | DAP10 | CD32 |
| BCA | DAP12 | DAP10 | CD79a |
| BCA | DAP12 | DAP10 | CD79b |
| BCA | DAP12 | DAP12 | CD8 |
| BCA | DAP12 | DAP12 | CD3ζ |
| BCA | DAP12 | DAP12 | CD3δ |
| BCA | DAP12 | DAP12 | CD3γ |
| BCA | DAP12 | DAP12 | CD3ε |
| BCA | DAP12 | DAP12 | FcγRI-γ |
| BCA | DAP12 | DAP12 | FcγRIII-γ |
| BCA | DAP12 | DAP12 | FcεRIβ |
| BCA | DAP12 | DAP12 | FcεRIγ |
| BCA | DAP12 | DAP12 | DAP10 |
| BCA | DAP12 | DAP12 | DAP12 |
| BCA | DAP12 | DAP12 | CD32 |
| BCA | DAP12 | DAP12 | CD79a |
| BCA | DAP12 | DAP12 | CD79b |
| BCA | DAP12 | MyD88 | CD8 |
| BCA | DAP12 | MyD88 | CD3ζ |
| BCA | DAP12 | MyD88 | CD3δ |
| BCA | DAP12 | MyD88 | CD3γ |
| BCA | DAP12 | MyD88 | CD3ε |
| BCA | DAP12 | MyD88 | FcγRI-γ |
| BCA | DAP12 | MyD88 | FcγRIII-γ |
| BCA | DAP12 | MyD88 | FcεRIβ |
| BCA | DAP12 | MyD88 | FcεRIγ |
| BCA | DAP12 | MyD88 | DAP10 |
| BCA | DAP12 | MyD88 | DAP12 |
| BCA | DAP12 | MyD88 | CD32 |
| BCA | DAP12 | MyD88 | CD79a |
| BCA | DAP12 | MyD88 | CD79b |
| BCA | DAP12 | CD7 | CD8 |
| BCA | DAP12 | CD7 | CD3ζ |
| BCA | DAP12 | CD7 | CD3δ |
| BCA | DAP12 | CD7 | CD3γ |
| BCA | DAP12 | CD7 | CD3ε |
| BCA | DAP12 | CD7 | FcγRI-γ |
| BCA | DAP12 | CD7 | FcγRIII-γ |
| BCA | DAP12 | CD7 | FcεRIβ |
| BCA | DAP12 | CD7 | FcεRIγ |
| BCA | DAP12 | CD7 | DAP10 |
| BCA | DAP12 | CD7 | DAP12 |

TABLE 3-continued

Third Generation CARs

| ScFv | Co-stimulatory Signal | Co-stimulatory Signal | Signal Domain |
|---|---|---|---|
| BCA | DAP12 | CD7 | CD32 |
| BCA | DAP12 | CD7 | CD79a |
| BCA | DAP12 | CD7 | CD79b |
| BCA | DAP12 | BTNL3 | CD8 |
| BCA | DAP12 | BTNL3 | CD3ζ |
| BCA | DAP12 | BTNL3 | CD3δ |
| BCA | DAP12 | BTNL3 | CD3γ |
| BCA | DAP12 | BTNL3 | CD3ε |
| BCA | DAP12 | BTNL3 | FcγRI-γ |
| BCA | DAP12 | BTNL3 | FcγRIII-γ |
| BCA | DAP12 | BTNL3 | FcεRIβ |
| BCA | DAP12 | BTNL3 | FcεRIγ |
| BCA | DAP12 | BTNL3 | DAP10 |
| BCA | DAP12 | BTNL3 | DAP12 |
| BCA | DAP12 | BTNL3 | CD32 |
| BCA | DAP12 | BTNL3 | CD79a |
| BCA | DAP12 | BTNL3 | CD79b |
| BCA | DAP12 | NKG2D | CD8 |
| BCA | DAP12 | NKG2D | CD3ζ |
| BCA | DAP12 | NKG2D | CD3δ |
| BCA | DAP12 | NKG2D | CD3γ |
| BCA | DAP12 | NKG2D | CD3ε |
| BCA | DAP12 | NKG2D | FcγRI-γ |
| BCA | DAP12 | NKG2D | FcγRIII-γ |
| BCA | DAP12 | NKG2D | FcεRIβ |
| BCA | DAP12 | NKG2D | FcεRIγ |
| BCA | DAP12 | NKG2D | DAP10 |
| BCA | DAP12 | NKG2D | DAP12 |
| BCA | DAP12 | NKG2D | CD32 |
| BCA | DAP12 | NKG2D | CD79a |
| BCA | DAP12 | NKG2D | CD79b |
| BCA | MyD88 | CD28 | CD8 |
| BCA | MyD88 | CD28 | CD3ζ |
| BCA | MyD88 | CD28 | CD3δ |
| BCA | MyD88 | CD28 | CD3γ |
| BCA | MyD88 | CD28 | CD3ε |
| BCA | MyD88 | CD28 | FcγRI-γ |
| BCA | MyD88 | CD28 | FcγRIII-γ |
| BCA | MyD88 | CD28 | FcεRIβ |
| BCA | MyD88 | CD28 | FcεRIγ |
| BCA | MyD88 | CD28 | DAP10 |
| BCA | MyD88 | CD28 | DAP12 |
| BCA | MyD88 | CD28 | CD32 |
| BCA | MyD88 | CD28 | CD79a |
| BCA | MyD88 | CD28 | CD79b |
| BCA | MyD88 | CD8 | CD8 |
| BCA | MyD88 | CD8 | CD3ζ |
| BCA | MyD88 | CD8 | CD3δ |
| BCA | MyD88 | CD8 | CD3γ |
| BCA | MyD88 | CD8 | CD3ε |
| BCA | MyD88 | CD8 | FcγRI-γ |
| BCA | MyD88 | CD8 | FcγRIII-γ |
| BCA | MyD88 | CD8 | FcεRIβ |
| BCA | MyD88 | CD8 | FcεRIγ |
| BCA | MyD88 | CD8 | DAP10 |
| BCA | MyD88 | CD8 | DAP12 |
| BCA | MyD88 | CD8 | CD32 |
| BCA | MyD88 | CD8 | CD79a |
| BCA | MyD88 | CD8 | CD79b |
| BCA | MyD88 | CD4 | CD8 |
| BCA | MyD88 | CD4 | CD3ζ |
| BCA | MyD88 | CD4 | CD3δ |
| BCA | MyD88 | CD4 | CD3γ |
| BCA | MyD88 | CD4 | CD3ε |
| BCA | MyD88 | CD4 | FcγRI-γ |
| BCA | MyD88 | CD4 | FcγRIII-γ |
| BCA | MyD88 | CD4 | FcεRIβ |
| BCA | MyD88 | CD4 | FcεRIγ |
| BCA | MyD88 | CD4 | DAP10 |
| BCA | MyD88 | CD4 | DAP12 |
| BCA | MyD88 | CD4 | CD32 |
| BCA | MyD88 | CD4 | CD79a |
| BCA | MyD88 | CD4 | CD79b |
| BCA | MyD88 | b2c | CD8 |
| BCA | MyD88 | b2c | CD3ζ |
| BCA | MyD88 | b2c | CD3δ |
| BCA | MyD88 | b2c | CD3γ |
| BCA | MyD88 | b2c | CD3ε |
| BCA | MyD88 | b2c | FcγRI-γ |
| BCA | MyD88 | b2c | FcγRIII-γ |
| BCA | MyD88 | b2c | FcεRIβ |
| BCA | MyD88 | b2c | FcεRIγ |
| BCA | MyD88 | b2c | DAP10 |
| BCA | MyD88 | b2c | DAP12 |
| BCA | MyD88 | b2c | CD32 |
| BCA | MyD88 | b2c | CD79a |
| BCA | MyD88 | b2c | CD79b |
| BCA | MyD88 | CD137/41BB | CD8 |
| BCA | MyD88 | CD137/41BB | CD3ζ |
| BCA | MyD88 | CD137/41BB | CD3δ |
| BCA | MyD88 | CD137/41BB | CD3γ |
| BCA | MyD88 | CD137/41BB | CD3ε |
| BCA | MyD88 | CD137/41BB | FcγRI-γ |
| BCA | MyD88 | CD137/41BB | FcγRIII-γ |
| BCA | MyD88 | CD137/41BB | FcεRIβ |
| BCA | MyD88 | CD137/41BB | FcεRIγ |
| BCA | MyD88 | CD137/41BB | DAP10 |
| BCA | MyD88 | CD137/41BB | DAP12 |
| BCA | MyD88 | CD137/41BB | CD32 |
| BCA | MyD88 | CD137/41BB | CD79a |
| BCA | MyD88 | CD137/41BB | CD79b |
| BCA | MyD88 | ICOS | CD8 |
| BCA | MyD88 | ICOS | CD3ζ |
| BCA | MyD88 | ICOS | CD3δ |
| BCA | MyD88 | ICOS | CD3γ |
| BCA | MyD88 | ICOS | CD3ε |
| BCA | MyD88 | ICOS | FcγRI-γ |
| BCA | MyD88 | ICOS | FcγRIII-γ |
| BCA | MyD88 | ICOS | FcεRIβ |
| BCA | MyD88 | ICOS | FcεRIγ |
| BCA | MyD88 | ICOS | DAP10 |
| BCA | MyD88 | ICOS | DAP12 |
| BCA | MyD88 | ICOS | CD32 |
| BCA | MyD88 | ICOS | CD79a |
| BCA | MyD88 | ICOS | CD79b |
| BCA | MyD88 | CD27 | CD8 |
| BCA | MyD88 | CD27 | CD3ζ |
| BCA | MyD88 | CD27 | CD3δ |
| BCA | MyD88 | CD27 | CD3γ |
| BCA | MyD88 | CD27 | CD3ε |
| BCA | MyD88 | CD27 | FcγRI-γ |
| BCA | MyD88 | CD27 | FcγRIII-γ |
| BCA | MyD88 | CD27 | FcεRIβ |
| BCA | MyD88 | CD27 | FcεRIγ |
| BCA | MyD88 | CD27 | DAP10 |
| BCA | MyD88 | CD27 | DAP12 |
| BCA | MyD88 | CD27 | CD32 |
| BCA | MyD88 | CD27 | CD79a |
| BCA | MyD88 | CD27 | CD79b |
| BCA | MyD88 | CD28δ | CD8 |
| BCA | MyD88 | CD28δ | CD3ζ |
| BCA | MyD88 | CD28δ | CD3δ |
| BCA | MyD88 | CD28δ | CD3γ |
| BCA | MyD88 | CD28δ | CD3ε |
| BCA | MyD88 | CD28δ | FcγRI-γ |
| BCA | MyD88 | CD28δ | FcγRIII-γ |
| BCA | MyD88 | CD28δ | FcεRIβ |
| BCA | MyD88 | CD28δ | FcεRIγ |
| BCA | MyD88 | CD28δ | DAP10 |
| BCA | MyD88 | CD28δ | DAP12 |
| BCA | MyD88 | CD28δ | CD32 |
| BCA | MyD88 | CD28δ | CD79a |
| BCA | MyD88 | CD28δ | CD79b |
| BCA | MyD88 | CD80 | CD8 |
| BCA | MyD88 | CD80 | CD3ζ |
| BCA | MyD88 | CD80 | CD3δ |
| BCA | MyD88 | CD80 | CD3γ |
| BCA | MyD88 | CD80 | CD3ε |
| BCA | MyD88 | CD80 | FcγRI-γ |
| BCA | MyD88 | CD80 | FcγRIII-γ |

TABLE 3-continued

Third Generation CARs

| ScFv | Co-stimulatory Signal | Co-stimulatory Signal | Signal Domain |
|---|---|---|---|
| BCA | MyD88 | CD80 | FcεRIβ |
| BCA | MyD88 | CD80 | FcεRIγ |
| BCA | MyD88 | CD80 | DAP10 |
| BCA | MyD88 | CD80 | DAP12 |
| BCA | MyD88 | CD80 | CD32 |
| BCA | MyD88 | CD80 | CD79a |
| BCA | MyD88 | CD80 | CD79b |
| BCA | MyD88 | CD86 | CD8 |
| BCA | MyD88 | CD86 | CD3ζ |
| BCA | MyD88 | CD86 | CD3δ |
| BCA | MyD88 | CD86 | CD3γ |
| BCA | MyD88 | CD86 | CD3ε |
| BCA | MyD88 | CD86 | FcγRI-γ |
| BCA | MyD88 | CD86 | FcγRIII-γ |
| BCA | MyD88 | CD86 | FcεRIβ |
| BCA | MyD88 | CD86 | FcεRIγ |
| BCA | MyD88 | CD86 | DAP10 |
| BCA | MyD88 | CD86 | DAP12 |
| BCA | MyD88 | CD86 | CD32 |
| BCA | MyD88 | CD86 | CD79a |
| BCA | MyD88 | CD86 | CD79b |
| BCA | MyD88 | OX40 | CD8 |
| BCA | MyD88 | OX40 | CD3ζ |
| BCA | MyD88 | OX40 | CD3δ |
| BCA | MyD88 | OX40 | CD3γ |
| BCA | MyD88 | OX40 | CD3ε |
| BCA | MyD88 | OX40 | FcγRI-γ |
| BCA | MyD88 | OX40 | FcγRIII-γ |
| BCA | MyD88 | OX40 | FcεRIβ |
| BCA | MyD88 | OX40 | FcεRIγ |
| BCA | MyD88 | OX40 | DAP10 |
| BCA | MyD88 | OX40 | DAP12 |
| BCA | MyD88 | OX40 | CD32 |
| BCA | MyD88 | OX40 | CD79a |
| BCA | MyD88 | OX40 | CD79b |
| BCA | MyD88 | DAP10 | CD8 |
| BCA | MyD88 | DAP10 | CD3ζ |
| BCA | MyD88 | DAP10 | CD3δ |
| BCA | MyD88 | DAP10 | CD3γ |
| BCA | MyD88 | DAP10 | CD3ε |
| BCA | MyD88 | DAP10 | FcγRI-γ |
| BCA | MyD88 | DAP10 | FcγRIII-γ |
| BCA | MyD88 | DAP10 | FcεRIβ |
| BCA | MyD88 | DAP10 | FcεRIγ |
| BCA | MyD88 | DAP10 | DAP10 |
| BCA | MyD88 | DAP10 | DAP12 |
| BCA | MyD88 | DAP10 | CD32 |
| BCA | MyD88 | DAP10 | CD79a |
| BCA | MyD88 | DAP10 | CD79b |
| BCA | MyD88 | DAP12 | CD8 |
| BCA | MyD88 | DAP12 | CD3ζ |
| BCA | MyD88 | DAP12 | CD3δ |
| BCA | MyD88 | DAP12 | CD3γ |
| BCA | MyD88 | DAP12 | CD3ε |
| BCA | MyD88 | DAP12 | FcγRI-γ |
| BCA | MyD88 | DAP12 | FcγRIII-γ |
| BCA | MyD88 | DAP12 | FcεRIβ |
| BCA | MyD88 | DAP12 | FcεRIγ |
| BCA | MyD88 | DAP12 | DAP10 |
| BCA | MyD88 | DAP12 | DAP12 |
| BCA | MyD88 | DAP12 | CD32 |
| BCA | MyD88 | DAP12 | CD79a |
| BCA | MyD88 | DAP12 | CD79b |
| BCA | MyD88 | MyD88 | CD8 |
| BCA | MyD88 | MyD88 | CD3ζ |
| BCA | MyD88 | MyD88 | CD3δ |
| BCA | MyD88 | MyD88 | CD3γ |
| BCA | MyD88 | MyD88 | CD3ε |
| BCA | MyD88 | MyD88 | FcγRI-γ |
| BCA | MyD88 | MyD88 | FcγRIII-γ |
| BCA | MyD88 | MyD88 | FcεRIβ |
| BCA | MyD88 | MyD88 | FcεRIγ |
| BCA | MyD88 | MyD88 | DAP10 |
| BCA | MyD88 | MyD88 | DAP12 |
| BCA | MyD88 | MyD88 | CD32 |
| BCA | MyD88 | MyD88 | CD79a |
| BCA | MyD88 | MyD88 | CD79b |
| BCA | MyD88 | CD7 | CD8 |
| BCA | MyD88 | CD7 | CD3ζ |
| BCA | MyD88 | CD7 | CD3δ |
| BCA | MyD88 | CD7 | CD3γ |
| BCA | MyD88 | CD7 | CD3ε |
| BCA | MyD88 | CD7 | FcγRI-γ |
| BCA | MyD88 | CD7 | FcγRIII-γ |
| BCA | MyD88 | CD7 | FcεRIβ |
| BCA | MyD88 | CD7 | FcεRIγ |
| BCA | MyD88 | CD7 | DAP10 |
| BCA | MyD88 | CD7 | DAP12 |
| BCA | MyD88 | CD7 | CD32 |
| BCA | MyD88 | CD7 | CD79a |
| BCA | MyD88 | CD7 | CD79b |
| BCA | MyD88 | BTNL3 | CD8 |
| BCA | MyD88 | BTNL3 | CD3ζ |
| BCA | MyD88 | BTNL3 | CD3δ |
| BCA | MyD88 | BTNL3 | CD3γ |
| BCA | MyD88 | BTNL3 | CD3ε |
| BCA | MyD88 | BTNL3 | FcγRI-γ |
| BCA | MyD88 | BTNL3 | FcγRIII-γ |
| BCA | MyD88 | BTNL3 | FcεRIβ |
| BCA | MyD88 | BTNL3 | FcεRIγ |
| BCA | MyD88 | BTNL3 | DAP10 |
| BCA | MyD88 | BTNL3 | DAP12 |
| BCA | MyD88 | BTNL3 | CD32 |
| BCA | MyD88 | BTNL3 | CD79a |
| BCA | MyD88 | BTNL3 | CD79b |
| BCA | MyD88 | NKG2D | CD8 |
| BCA | MyD88 | NKG2D | CD3ζ |
| BCA | MyD88 | NKG2D | CD3δ |
| BCA | MyD88 | NKG2D | CD3γ |
| BCA | MyD88 | NKG2D | CD3ε |
| BCA | MyD88 | NKG2D | FcγRI-γ |
| BCA | MyD88 | NKG2D | FcγRIII-γ |
| BCA | MyD88 | NKG2D | FcεRIβ |
| BCA | MyD88 | NKG2D | FcεRIγ |
| BCA | MyD88 | NKG2D | DAP10 |
| BCA | MyD88 | NKG2D | DAP12 |
| BCA | MyD88 | NKG2D | CD32 |
| BCA | MyD88 | NKG2D | CD79a |
| BCA | MyD88 | NKG2D | CD79b |
| BCA | CD7 | CD28 | CD8 |
| BCA | CD7 | CD28 | CD3ζ |
| BCA | CD7 | CD28 | CD3δ |
| BCA | CD7 | CD28 | CD3γ |
| BCA | CD7 | CD28 | CD3ε |
| BCA | CD7 | CD28 | FcγRI-γ |
| BCA | CD7 | CD28 | FcγRIII-γ |
| BCA | CD7 | CD28 | FcεRIβ |
| BCA | CD7 | CD28 | FcεRIγ |
| BCA | CD7 | CD28 | DAP10 |
| BCA | CD7 | CD28 | DAP12 |
| BCA | CD7 | CD28 | CD32 |
| BCA | CD7 | CD28 | CD79a |
| BCA | CD7 | CD28 | CD79b |
| BCA | CD7 | CD8 | CD8 |
| BCA | CD7 | CD8 | CD3ζ |
| BCA | CD7 | CD8 | CD3δ |
| BCA | CD7 | CD8 | CD3γ |
| BCA | CD7 | CD8 | CD3ε |
| BCA | CD7 | CD8 | FcγRI-γ |
| BCA | CD7 | CD8 | FcγRIII-γ |
| BCA | CD7 | CD8 | FcεRIβ |
| BCA | CD7 | CD8 | FcεRIγ |
| BCA | CD7 | CD8 | DAP10 |
| BCA | CD7 | CD8 | DAP12 |
| BCA | CD7 | CD8 | CD32 |
| BCA | CD7 | CD8 | CD79a |
| BCA | CD7 | CD8 | CD79b |
| BCA | CD7 | CD4 | CD8 |
| BCA | CD7 | CD4 | CD3ζ |
| BCA | CD7 | CD4 | CD3δ |

TABLE 3-continued

Third Generation CARs

| ScFv | Co-stimulatory Signal | Co-stimulatory Signal | Signal Domain |
|------|----------------------|----------------------|---------------|
| BCA | CD7 | CD4 | CD3γ |
| BCA | CD7 | CD4 | CD3ε |
| BCA | CD7 | CD4 | FcγRI-γ |
| BCA | CD7 | CD4 | FcγRIII-γ |
| BCA | CD7 | CD4 | FcεRIβ |
| BCA | CD7 | CD4 | FcεRIγ |
| BCA | CD7 | CD4 | DAP10 |
| BCA | CD7 | CD4 | DAP12 |
| BCA | CD7 | CD4 | CD32 |
| BCA | CD7 | CD4 | CD79a |
| BCA | CD7 | CD4 | CD79b |
| BCA | CD7 | b2c | CD8 |
| BCA | CD7 | b2c | CD3ζ |
| BCA | CD7 | b2c | CD3δ |
| BCA | CD7 | b2c | CD3γ |
| BCA | CD7 | b2c | CD3ε |
| BCA | CD7 | b2c | FcγRI-γ |
| BCA | CD7 | b2c | FcγRIII-γ |
| BCA | CD7 | b2c | FcεRIβ |
| BCA | CD7 | b2c | FcεRIγ |
| BCA | CD7 | b2c | DAP10 |
| BCA | CD7 | b2c | DAP12 |
| BCA | CD7 | b2c | CD32 |
| BCA | CD7 | b2c | CD79a |
| BCA | CD7 | b2c | CD79b |
| BCA | CD7 | CD137/41BB | CD8 |
| BCA | CD7 | CD137/41BB | CD3ζ |
| BCA | CD7 | CD137/41BB | CD3δ |
| BCA | CD7 | CD137/41BB | CD3γ |
| BCA | CD7 | CD137/41BB | CD3ε |
| BCA | CD7 | CD137/41BB | FcγRI-γ |
| BCA | CD7 | CD137/41BB | FcγRIII-γ |
| BCA | CD7 | CD137/41BB | FcεRIβ |
| BCA | CD7 | CD137/41BB | FcεRIγ |
| BCA | CD7 | CD137/41BB | DAP10 |
| BCA | CD7 | CD137/41BB | DAP12 |
| BCA | CD7 | CD137/41BB | CD32 |
| BCA | CD7 | CD137/41BB | CD79a |
| BCA | CD7 | CD137/41BB | CD79b |
| BCA | CD7 | ICOS | CD8 |
| BCA | CD7 | ICOS | CD3ζ |
| BCA | CD7 | ICOS | CD3δ |
| BCA | CD7 | ICOS | CD3γ |
| BCA | CD7 | ICOS | CD3ε |
| BCA | CD7 | ICOS | FcγRI-γ |
| BCA | CD7 | ICOS | FcγRIII-γ |
| BCA | CD7 | ICOS | FcεRIβ |
| BCA | CD7 | ICOS | FcεRIγ |
| BCA | CD7 | ICOS | DAP10 |
| BCA | CD7 | ICOS | DAP12 |
| BCA | CD7 | ICOS | CD32 |
| BCA | CD7 | ICOS | CD79a |
| BCA | CD7 | ICOS | CD79b |
| BCA | CD7 | CD27 | CD8 |
| BCA | CD7 | CD27 | CD3ζ |
| BCA | CD7 | CD27 | CD3δ |
| BCA | CD7 | CD27 | CD3γ |
| BCA | CD7 | CD27 | CD3ε |
| BCA | CD7 | CD27 | FcγRI-γ |
| BCA | CD7 | CD27 | FcγRIII-γ |
| BCA | CD7 | CD27 | FcεRIβ |
| BCA | CD7 | CD27 | FcεRIγ |
| BCA | CD7 | CD27 | DAP10 |
| BCA | CD7 | CD27 | DAP12 |
| BCA | CD7 | CD27 | CD32 |
| BCA | CD7 | CD27 | CD79a |
| BCA | CD7 | CD27 | CD79b |
| BCA | CD7 | CD28δ | CD8 |
| BCA | CD7 | CD28δ | CD3ζ |
| BCA | CD7 | CD28δ | CD3δ |
| BCA | CD7 | CD28δ | CD3γ |
| BCA | CD7 | CD28δ | CD3ε |
| BCA | CD7 | CD28δ | FcγRI-γ |
| BCA | CD7 | CD28δ | FcγRIII-γ |
| BCA | CD7 | CD28δ | FcεRIβ |
| BCA | CD7 | CD28δ | FcεRIγ |
| BCA | CD7 | CD28δ | DAP10 |
| BCA | CD7 | CD28δ | DAP12 |
| BCA | CD7 | CD28δ | CD32 |
| BCA | CD7 | CD28δ | CD79a |
| BCA | CD7 | CD28δ | CD79b |
| BCA | CD7 | CD80 | CD8 |
| BCA | CD7 | CD80 | CD3ζ |
| BCA | CD7 | CD80 | CD3δ |
| BCA | CD7 | CD80 | CD3γ |
| BCA | CD7 | CD80 | CD3ε |
| BCA | CD7 | CD80 | FcγRI-γ |
| BCA | CD7 | CD80 | FcγRIII-γ |
| BCA | CD7 | CD80 | FcεRIβ |
| BCA | CD7 | CD80 | FcεRIγ |
| BCA | CD7 | CD80 | DAP10 |
| BCA | CD7 | CD80 | DAP12 |
| BCA | CD7 | CD80 | CD32 |
| BCA | CD7 | CD80 | CD79a |
| BCA | CD7 | CD80 | CD79b |
| BCA | CD7 | CD86 | CD8 |
| BCA | CD7 | CD86 | CD3ζ |
| BCA | CD7 | CD86 | CD3δ |
| BCA | CD7 | CD86 | CD3γ |
| BCA | CD7 | CD86 | CD3ε |
| BCA | CD7 | CD86 | FcγRI-γ |
| BCA | CD7 | CD86 | FcγRIII-γ |
| BCA | CD7 | CD86 | FcεRIβ |
| BCA | CD7 | CD86 | FcεRIγ |
| BCA | CD7 | CD86 | DAP10 |
| BCA | CD7 | CD86 | DAP12 |
| BCA | CD7 | CD86 | CD32 |
| BCA | CD7 | CD86 | CD79a |
| BCA | CD7 | CD86 | CD79b |
| BCA | CD7 | OX40 | CD8 |
| BCA | CD7 | OX40 | CD3ζ |
| BCA | CD7 | OX40 | CD3δ |
| BCA | CD7 | OX40 | CD3γ |
| BCA | CD7 | OX40 | CD3ε |
| BCA | CD7 | OX40 | FcγRI-γ |
| BCA | CD7 | OX40 | FcγRIII-γ |
| BCA | CD7 | OX40 | FcεRIβ |
| BCA | CD7 | OX40 | FcεRIγ |
| BCA | CD7 | OX40 | DAP10 |
| BCA | CD7 | OX40 | DAP12 |
| BCA | CD7 | OX40 | CD32 |
| BCA | CD7 | OX40 | CD79a |
| BCA | CD7 | OX40 | CD79b |
| BCA | CD7 | DAP10 | CD8 |
| BCA | CD7 | DAP10 | CD3ζ |
| BCA | CD7 | DAP10 | CD3δ |
| BCA | CD7 | DAP10 | CD3γ |
| BCA | CD7 | DAP10 | CD3ε |
| BCA | CD7 | DAP10 | FcγRI-γ |
| BCA | CD7 | DAP10 | FcγRIII-γ |
| BCA | CD7 | DAP10 | FcεRIβ |
| BCA | CD7 | DAP10 | FcεRIγ |
| BCA | CD7 | DAP10 | DAP10 |
| BCA | CD7 | DAP10 | DAP12 |
| BCA | CD7 | DAP10 | CD32 |
| BCA | CD7 | DAP10 | CD79a |
| BCA | CD7 | DAP10 | CD79b |
| BCA | CD7 | DAP12 | CD8 |
| BCA | CD7 | DAP12 | CD3ζ |
| BCA | CD7 | DAP12 | CD3δ |
| BCA | CD7 | DAP12 | CD3γ |
| BCA | CD7 | DAP12 | CD3ε |
| BCA | CD7 | DAP12 | FcγRI-γ |
| BCA | CD7 | DAP12 | FcγRIII-γ |
| BCA | CD7 | DAP12 | FcεRIβ |
| BCA | CD7 | DAP12 | FcεRIγ |
| BCA | CD7 | DAP12 | DAP10 |
| BCA | CD7 | DAP12 | DAP12 |
| BCA | CD7 | DAP12 | CD32 |
| BCA | CD7 | DAP12 | CD79a |

TABLE 3-continued

Third Generation CARs

| ScFv | Co-stimulatory Signal | Co-stimulatory Signal | Signal Domain |
|---|---|---|---|
| BCA | CD7 | DAP12 | CD79b |
| BCA | CD7 | MyD88 | CD8 |
| BCA | CD7 | MyD88 | CD3ζ |
| BCA | CD7 | MyD88 | CD3δ |
| BCA | CD7 | MyD88 | CD3γ |
| BCA | CD7 | MyD88 | CD3ε |
| BCA | CD7 | MyD88 | FcγRI-γ |
| BCA | CD7 | MyD88 | FcγRIII-γ |
| BCA | CD7 | MyD88 | FcεRIβ |
| BCA | CD7 | MyD88 | FcεRIγ |
| BCA | CD7 | MyD88 | DAP10 |
| BCA | CD7 | MyD88 | DAP12 |
| BCA | CD7 | MyD88 | CD32 |
| BCA | CD7 | MyD88 | CD79a |
| BCA | CD7 | MyD88 | CD79b |
| BCA | CD7 | CD7 | CD8 |
| BCA | CD7 | CD7 | CD3ζ |
| BCA | CD7 | CD7 | CD3δ |
| BCA | CD7 | CD7 | CD3γ |
| BCA | CD7 | CD7 | CD3ε |
| BCA | CD7 | CD7 | FcγRI-γ |
| BCA | CD7 | CD7 | FcγRIII-γ |
| BCA | CD7 | CD7 | FcεRIβ |
| BCA | CD7 | CD7 | FcεRIγ |
| BCA | CD7 | CD7 | DAP10 |
| BCA | CD7 | CD7 | DAP12 |
| BCA | CD7 | CD7 | CD32 |
| BCA | CD7 | CD7 | CD79a |
| BCA | CD7 | CD7 | CD79b |
| BCA | CD7 | BTNL3 | CD8 |
| BCA | CD7 | BTNL3 | CD3ζ |
| BCA | CD7 | BTNL3 | CD3δ |
| BCA | CD7 | BTNL3 | CD3γ |
| BCA | CD7 | BTNL3 | CD3ε |
| BCA | CD7 | BTNL3 | FcγRI-γ |
| BCA | CD7 | BTNL3 | FcγRIII-γ |
| BCA | CD7 | BTNL3 | FcεRIβ |
| BCA | CD7 | BTNL3 | FcεRIγ |
| BCA | CD7 | BTNL3 | DAP10 |
| BCA | CD7 | BTNL3 | DAP12 |
| BCA | CD7 | BTNL3 | CD32 |
| BCA | CD7 | BTNL3 | CD79a |
| BCA | CD7 | BTNL3 | CD79b |
| BCA | CD7 | NKG2D | CD8 |
| BCA | CD7 | NKG2D | CD3ζ |
| BCA | CD7 | NKG2D | CD3δ |
| BCA | CD7 | NKG2D | CD3γ |
| BCA | CD7 | NKG2D | CD3ε |
| BCA | CD7 | NKG2D | FcγRI-γ |
| BCA | CD7 | NKG2D | FcγRIII-γ |
| BCA | CD7 | NKG2D | FcεRIβ |
| BCA | CD7 | NKG2D | FcεRIγ |
| BCA | CD7 | NKG2D | DAP10 |
| BCA | CD7 | NKG2D | DAP12 |
| BCA | CD7 | NKG2D | CD32 |
| BCA | CD7 | NKG2D | CD79a |
| BCA | CD7 | NKG2D | CD79b |
| BCA | BTNL3 | CD28 | CD8 |
| BCA | BTNL3 | CD28 | CD3ζ |
| BCA | BTNL3 | CD28 | CD3δ |
| BCA | BTNL3 | CD28 | CD3γ |
| BCA | BTNL3 | CD28 | CD3ε |
| BCA | BTNL3 | CD28 | FcγRI-γ |
| BCA | BTNL3 | CD28 | FcγRIII-γ |
| BCA | BTNL3 | CD28 | FcεRIβ |
| BCA | BTNL3 | CD28 | FcεRIγ |
| BCA | BTNL3 | CD28 | DAP10 |
| BCA | BTNL3 | CD28 | DAP12 |
| BCA | BTNL3 | CD28 | CD32 |
| BCA | BTNL3 | CD28 | CD79a |
| BCA | BTNL3 | CD28 | CD79b |
| BCA | BTNL3 | CD8 | CD8 |
| BCA | BTNL3 | CD8 | CD3ζ |
| BCA | BTNL3 | CD8 | CD3δ |
| BCA | BTNL3 | CD8 | CD3γ |
| BCA | BTNL3 | CD8 | CD3ε |
| BCA | BTNL3 | CD8 | FcγRI-γ |
| BCA | BTNL3 | CD8 | FcγRIII-γ |
| BCA | BTNL3 | CD8 | FcεRIβ |
| BCA | BTNL3 | CD8 | FcεRIγ |
| BCA | BTNL3 | CD8 | DAP10 |
| BCA | BTNL3 | CD8 | DAP12 |
| BCA | BTNL3 | CD8 | CD32 |
| BCA | BTNL3 | CD8 | CD79a |
| BCA | BTNL3 | CD8 | CD79b |
| BCA | BTNL3 | CD4 | CD8 |
| BCA | BTNL3 | CD4 | CD3ζ |
| BCA | BTNL3 | CD4 | CD3δ |
| BCA | BTNL3 | CD4 | CD3γ |
| BCA | BTNL3 | CD4 | CD3ε |
| BCA | BTNL3 | CD4 | FcγRI-γ |
| BCA | BTNL3 | CD4 | FcγRIII-γ |
| BCA | BTNL3 | CD4 | FcεRIβ |
| BCA | BTNL3 | CD4 | FcεRIγ |
| BCA | BTNL3 | CD4 | DAP10 |
| BCA | BTNL3 | CD4 | DAP12 |
| BCA | BTNL3 | CD4 | CD32 |
| BCA | BTNL3 | CD4 | CD79a |
| BCA | BTNL3 | CD4 | CD79b |
| BCA | BTNL3 | b2c | CD8 |
| BCA | BTNL3 | b2c | CD3ζ |
| BCA | BTNL3 | b2c | CD3δ |
| BCA | BTNL3 | b2c | CD3γ |
| BCA | BTNL3 | b2c | CD3ε |
| BCA | BTNL3 | b2c | FcγRI-γ |
| BCA | BTNL3 | b2c | FcγRIII-γ |
| BCA | BTNL3 | b2c | FcεRIβ |
| BCA | BTNL3 | b2c | FcεRIγ |
| BCA | BTNL3 | b2c | DAP10 |
| BCA | BTNL3 | b2c | DAP12 |
| BCA | BTNL3 | b2c | CD32 |
| BCA | BTNL3 | b2c | CD79a |
| BCA | BTNL3 | b2c | CD79b |
| BCA | BTNL3 | CD137/41BB | CD8 |
| BCA | BTNL3 | CD137/41BB | CD3ζ |
| BCA | BTNL3 | CD137/41BB | CD3δ |
| BCA | BTNL3 | CD137/41BB | CD3γ |
| BCA | BTNL3 | CD137/41BB | CD3ε |
| BCA | BTNL3 | CD137/41BB | FcγRI-γ |
| BCA | BTNL3 | CD137/41BB | FcγRIII-γ |
| BCA | BTNL3 | CD137/41BB | FcεRIβ |
| BCA | BTNL3 | CD137/41BB | FcεRIγ |
| BCA | BTNL3 | CD137/41BB | DAP10 |
| BCA | BTNL3 | CD137/41BB | DAP12 |
| BCA | BTNL3 | CD137/41BB | CD32 |
| BCA | BTNL3 | CD137/41BB | CD79a |
| BCA | BTNL3 | CD137/41BB | CD79b |
| BCA | BTNL3 | ICOS | CD8 |
| BCA | BTNL3 | ICOS | CD3ζ |
| BCA | BTNL3 | ICOS | CD3δ |
| BCA | BTNL3 | ICOS | CD3γ |
| BCA | BTNL3 | ICOS | CD3ε |
| BCA | BTNL3 | ICOS | FcγRI-γ |
| BCA | BTNL3 | ICOS | FcγRIII-γ |
| BCA | BTNL3 | ICOS | FcεRIβ |
| BCA | BTNL3 | ICOS | FcεRIγ |
| BCA | BTNL3 | ICOS | DAP10 |
| BCA | BTNL3 | ICOS | DAP12 |
| BCA | BTNL3 | ICOS | CD32 |
| BCA | BTNL3 | ICOS | CD79a |
| BCA | BTNL3 | ICOS | CD79b |
| BCA | BTNL3 | CD27 | CD8 |
| BCA | BTNL3 | CD27 | CD3ζ |
| BCA | BTNL3 | CD27 | CD3δ |
| BCA | BTNL3 | CD27 | CD3γ |
| BCA | BTNL3 | CD27 | CD3ε |
| BCA | BTNL3 | CD27 | FcγRI-γ |
| BCA | BTNL3 | CD27 | FcγRIII-γ |
| BCA | BTNL3 | CD27 | FcεRIβ |
| BCA | BTNL3 | CD27 | FcεRIγ |

TABLE 3-continued

Third Generation CARs

| ScFv | Co-stimulatory Signal | Co-stimulatory Signal | Signal Domain |
|---|---|---|---|
| BCA | BTNL3 | CD27 | DAP10 |
| BCA | BTNL3 | CD27 | DAP12 |
| BCA | BTNL3 | CD27 | CD32 |
| BCA | BTNL3 | CD27 | CD79a |
| BCA | BTNL3 | CD27 | CD79b |
| BCA | BTNL3 | CD28δ | CD8 |
| BCA | BTNL3 | CD28δ | CD3ζ |
| BCA | BTNL3 | CD28δ | CD3δ |
| BCA | BTNL3 | CD28δ | CD3γ |
| BCA | BTNL3 | CD28δ | CD3ε |
| BCA | BTNL3 | CD28δ | FcγRI-γ |
| BCA | BTNL3 | CD28δ | FcγRIII-γ |
| BCA | BTNL3 | CD28δ | FcεRIβ |
| BCA | BTNL3 | CD28δ | FcεRIγ |
| BCA | BTNL3 | CD28δ | DAP10 |
| BCA | BTNL3 | CD28δ | DAP12 |
| BCA | BTNL3 | CD28δ | CD32 |
| BCA | BTNL3 | CD28δ | CD79a |
| BCA | BTNL3 | CD28δ | CD79b |
| BCA | BTNL3 | CD80 | CD8 |
| BCA | BTNL3 | CD80 | CD3ζ |
| BCA | BTNL3 | CD80 | CD3δ |
| BCA | BTNL3 | CD80 | CD3γ |
| BCA | BTNL3 | CD80 | CD3ε |
| BCA | BTNL3 | CD80 | FcγRI-γ |
| BCA | BTNL3 | CD80 | FcγRIII-γ |
| BCA | BTNL3 | CD80 | FcεRIβ |
| BCA | BTNL3 | CD80 | FcεRIγ |
| BCA | BTNL3 | CD80 | DAP10 |
| BCA | BTNL3 | CD80 | DAP12 |
| BCA | BTNL3 | CD80 | CD32 |
| BCA | BTNL3 | CD80 | CD79a |
| BCA | BTNL3 | CD80 | CD79b |
| BCA | BTNL3 | CD86 | CD8 |
| BCA | BTNL3 | CD86 | CD3ζ |
| BCA | BTNL3 | CD86 | CD3δ |
| BCA | BTNL3 | CD86 | CD3γ |
| BCA | BTNL3 | CD86 | CD3ε |
| BCA | BTNL3 | CD86 | FcγRI-γ |
| BCA | BTNL3 | CD86 | FcγRIII-γ |
| BCA | BTNL3 | CD86 | FcεRIβ |
| BCA | BTNL3 | CD86 | FcεRIγ |
| BCA | BTNL3 | CD86 | DAP10 |
| BCA | BTNL3 | CD86 | DAP12 |
| BCA | BTNL3 | CD86 | CD32 |
| BCA | BTNL3 | CD86 | CD79a |
| BCA | BTNL3 | CD86 | CD79b |
| BCA | BTNL3 | OX40 | CD8 |
| BCA | BTNL3 | OX40 | CD3ζ |
| BCA | BTNL3 | OX40 | CD3δ |
| BCA | BTNL3 | OX40 | CD3γ |
| BCA | BTNL3 | OX40 | CD3ε |
| BCA | BTNL3 | OX40 | FcγRI-γ |
| BCA | BTNL3 | OX40 | FcγRIII-γ |
| BCA | BTNL3 | OX40 | FcεRIβ |
| BCA | BTNL3 | OX40 | FcεRIγ |
| BCA | BTNL3 | OX40 | DAP10 |
| BCA | BTNL3 | OX40 | DAP12 |
| BCA | BTNL3 | OX40 | CD32 |
| BCA | BTNL3 | OX40 | CD79a |
| BCA | BTNL3 | OX40 | CD79b |
| BCA | BTNL3 | DAP10 | CD8 |
| BCA | BTNL3 | DAP10 | CD3ζ |
| BCA | BTNL3 | DAP10 | CD3δ |
| BCA | BTNL3 | DAP10 | CD3γ |
| BCA | BTNL3 | DAP10 | CD3ε |
| BCA | BTNL3 | DAP10 | FcγRI-γ |
| BCA | BTNL3 | DAP10 | FcγRIII-γ |
| BCA | BTNL3 | DAP10 | FcεRIβ |
| BCA | BTNL3 | DAP10 | FcεRIγ |
| BCA | BTNL3 | DAP10 | DAP10 |
| BCA | BTNL3 | DAP10 | DAP12 |
| BCA | BTNL3 | DAP10 | CD32 |
| BCA | BTNL3 | DAP10 | CD79a |
| BCA | BTNL3 | DAP10 | CD79b |
| BCA | BTNL3 | DAP12 | CD8 |
| BCA | BTNL3 | DAP12 | CD3ζ |
| BCA | BTNL3 | DAP12 | CD3δ |
| BCA | BTNL3 | DAP12 | CD3γ |
| BCA | BTNL3 | DAP12 | CD3ε |
| BCA | BTNL3 | DAP12 | FcγRI-γ |
| BCA | BTNL3 | DAP12 | FcγRIII-γ |
| BCA | BTNL3 | DAP12 | FcεRIβ |
| BCA | BTNL3 | DAP12 | FcεRIγ |
| BCA | BTNL3 | DAP12 | DAP10 |
| BCA | BTNL3 | DAP12 | DAP12 |
| BCA | BTNL3 | DAP12 | CD32 |
| BCA | BTNL3 | DAP12 | CD79a |
| BCA | BTNL3 | DAP12 | CD79b |
| BCA | BTNL3 | MyD88 | CD8 |
| BCA | BTNL3 | MyD88 | CD3ζ |
| BCA | BTNL3 | MyD88 | CD3δ |
| BCA | BTNL3 | MyD88 | CD3γ |
| BCA | BTNL3 | MyD88 | CD3ε |
| BCA | BTNL3 | MyD88 | FcγRI-γ |
| BCA | BTNL3 | MyD88 | FcγRIII-γ |
| BCA | BTNL3 | MyD88 | FcεRIβ |
| BCA | BTNL3 | MyD88 | FcεRIγ |
| BCA | BTNL3 | MyD88 | DAP10 |
| BCA | BTNL3 | MyD88 | DAP12 |
| BCA | BTNL3 | MyD88 | CD32 |
| BCA | BTNL3 | MyD88 | CD79a |
| BCA | BTNL3 | MyD88 | CD79b |
| BCA | BTNL3 | CD7 | CD8 |
| BCA | BTNL3 | CD7 | CD3ζ |
| BCA | BTNL3 | CD7 | CD3δ |
| BCA | BTNL3 | CD7 | CD3γ |
| BCA | BTNL3 | CD7 | CD3ε |
| BCA | BTNL3 | CD7 | FcγRI-γ |
| BCA | BTNL3 | CD7 | FcγRIII-γ |
| BCA | BTNL3 | CD7 | FcεRIβ |
| BCA | BTNL3 | CD7 | FcεRIγ |
| BCA | BTNL3 | CD7 | DAP10 |
| BCA | BTNL3 | CD7 | DAP12 |
| BCA | BTNL3 | CD7 | CD32 |
| BCA | BTNL3 | CD7 | CD79a |
| BCA | BTNL3 | CD7 | CD79b |
| BCA | BTNL3 | BTNL3 | CD8 |
| BCA | BTNL3 | BTNL3 | CD3ζ |
| BCA | BTNL3 | BTNL3 | CD3δ |
| BCA | BTNL3 | BTNL3 | CD3γ |
| BCA | BTNL3 | BTNL3 | CD3ε |
| BCA | BTNL3 | BTNL3 | FcγRI-γ |
| BCA | BTNL3 | BTNL3 | FcγRIII-γ |
| BCA | BTNL3 | BTNL3 | FcεRIβ |
| BCA | BTNL3 | BTNL3 | FcεRIγ |
| BCA | BTNL3 | BTNL3 | DAP10 |
| BCA | BTNL3 | BTNL3 | DAP12 |
| BCA | BTNL3 | BTNL3 | CD32 |
| BCA | BTNL3 | BTNL3 | CD79a |
| BCA | BTNL3 | BTNL3 | CD79b |
| BCA | BTNL3 | NKG2D | CD8 |
| BCA | BTNL3 | NKG2D | CD3ζ |
| BCA | BTNL3 | NKG2D | CD3δ |
| BCA | BTNL3 | NKG2D | CD3γ |
| BCA | BTNL3 | NKG2D | CD3ε |
| BCA | BTNL3 | NKG2D | FcγRI-γ |
| BCA | BTNL3 | NKG2D | FcγRIII-γ |
| BCA | BTNL3 | NKG2D | FcεRIβ |
| BCA | BTNL3 | NKG2D | FcεRIγ |
| BCA | BTNL3 | NKG2D | DAP10 |
| BCA | BTNL3 | NKG2D | DAP12 |
| BCA | BTNL3 | NKG2D | CD32 |
| BCA | BTNL3 | NKG2D | CD79a |
| BCA | BTNL3 | NKG2D | CD79b |
| BCA | NKG2D | CD28 | CD8 |
| BCA | NKG2D | CD28 | CD3ζ |
| BCA | NKG2D | CD28 | CD3δ |
| BCA | NKG2D | CD28 | CD3γ |
| BCA | NKG2D | CD28 | CD3ε |

TABLE 3-continued

Third Generation CARs

| ScFv | Co-stimulatory Signal | Co-stimulatory Signal | Signal Domain |
|---|---|---|---|
| BCA | NKG2D | CD28 | FcγRI-γ |
| BCA | NKG2D | CD28 | FcγRIII-γ |
| BCA | NKG2D | CD28 | FcεRIβ |
| BCA | NKG2D | CD28 | FcεRIγ |
| BCA | NKG2D | CD28 | DAP10 |
| BCA | NKG2D | CD28 | DAP12 |
| BCA | NKG2D | CD28 | CD32 |
| BCA | NKG2D | CD28 | CD79a |
| BCA | NKG2D | CD28 | CD79b |
| BCA | NKG2D | CD8 | CD8 |
| BCA | NKG2D | CD8 | CD3ζ |
| BCA | NKG2D | CD8 | CD3δ |
| BCA | NKG2D | CD8 | CD3γ |
| BCA | NKG2D | CD8 | CD3ε |
| BCA | NKG2D | CD8 | FcγRI-γ |
| BCA | NKG2D | CD8 | FcγRIII-γ |
| BCA | NKG2D | CD8 | FcεRIβ |
| BCA | NKG2D | CD8 | FcεRIγ |
| BCA | NKG2D | CD8 | DAP10 |
| BCA | NKG2D | CD8 | DAP12 |
| BCA | NKG2D | CD8 | CD32 |
| BCA | NKG2D | CD8 | CD79a |
| BCA | NKG2D | CD8 | CD79b |
| BCA | NKG2D | CD4 | CD8 |
| BCA | NKG2D | CD4 | CD3ζ |
| BCA | NKG2D | CD4 | CD3δ |
| BCA | NKG2D | CD4 | CD3γ |
| BCA | NKG2D | CD4 | CD3ε |
| BCA | NKG2D | CD4 | FcγRI-γ |
| BCA | NKG2D | CD4 | FcγRIII-γ |
| BCA | NKG2D | CD4 | FcεRIβ |
| BCA | NKG2D | CD4 | FcεRIγ |
| BCA | NKG2D | CD4 | DAP10 |
| BCA | NKG2D | CD4 | DAP12 |
| BCA | NKG2D | CD4 | CD32 |
| BCA | NKG2D | CD4 | CD79a |
| BCA | NKG2D | CD4 | CD79b |
| BCA | NKG2D | b2c | CD8 |
| BCA | NKG2D | b2c | CD3ζ |
| BCA | NKG2D | b2c | CD3δ |
| BCA | NKG2D | b2c | CD3γ |
| BCA | NKG2D | b2c | CD3ε |
| BCA | NKG2D | b2c | FcγRI-γ |
| BCA | NKG2D | b2c | FcγRIII-γ |
| BCA | NKG2D | b2c | FcεRIβ |
| BCA | NKG2D | b2c | FcεRIγ |
| BCA | NKG2D | b2c | DAP10 |
| BCA | NKG2D | b2c | DAP12 |
| BCA | NKG2D | b2c | CD32 |
| BCA | NKG2D | b2c | CD79a |
| BCA | NKG2D | b2c | CD79b |
| BCA | NKG2D | CD137/41BB | CD8 |
| BCA | NKG2D | CD137/41BB | CD3ζ |
| BCA | NKG2D | CD137/41BB | CD3δ |
| BCA | NKG2D | CD137/41BB | CD3γ |
| BCA | NKG2D | CD137/41BB | CD3ε |
| BCA | NKG2D | CD137/41BB | FcγRI-γ |
| BCA | NKG2D | CD137/41BB | FcγRIII-γ |
| BCA | NKG2D | CD137/41BB | FcεRIβ |
| BCA | NKG2D | CD137/41BB | FcεRIγ |
| BCA | NKG2D | CD137/41BB | DAP10 |
| BCA | NKG2D | CD137/41BB | DAP12 |
| BCA | NKG2D | CD137/41BB | CD32 |
| BCA | NKG2D | CD137/41BB | CD79a |
| BCA | NKG2D | CD137/41BB | CD79b |
| BCA | NKG2D | ICOS | CD8 |
| BCA | NKG2D | ICOS | CD3ζ |
| BCA | NKG2D | ICOS | CD3δ |
| BCA | NKG2D | ICOS | CD3γ |
| BCA | NKG2D | ICOS | CD3ε |
| BCA | NKG2D | ICOS | FcγRI-γ |
| BCA | NKG2D | ICOS | FcγRIII-γ |
| BCA | NKG2D | ICOS | FcεRIβ |
| BCA | NKG2D | ICOS | FcεRIγ |
| BCA | NKG2D | ICOS | DAP10 |
| BCA | NKG2D | ICOS | DAP12 |
| BCA | NKG2D | ICOS | CD32 |
| BCA | NKG2D | ICOS | CD79a |
| BCA | NKG2D | ICOS | CD79b |
| BCA | NKG2D | CD27 | CD8 |
| BCA | NKG2D | CD27 | CD3ζ |
| BCA | NKG2D | CD27 | CD3δ |
| BCA | NKG2D | CD27 | CD3γ |
| BCA | NKG2D | CD27 | CD3ε |
| BCA | NKG2D | CD27 | FcγRI-γ |
| BCA | NKG2D | CD27 | FcγRIII-γ |
| BCA | NKG2D | CD27 | FcεRIβ |
| BCA | NKG2D | CD27 | FcεRIγ |
| BCA | NKG2D | CD27 | DAP10 |
| BCA | NKG2D | CD27 | DAP12 |
| BCA | NKG2D | CD27 | CD32 |
| BCA | NKG2D | CD27 | CD79a |
| BCA | NKG2D | CD27 | CD79b |
| BCA | NKG2D | CD28δ | CD8 |
| BCA | NKG2D | CD28δ | CD3ζ |
| BCA | NKG2D | CD28δ | CD3δ |
| BCA | NKG2D | CD28δ | CD3γ |
| BCA | NKG2D | CD28δ | CD3ε |
| BCA | NKG2D | CD28δ | FcγRI-γ |
| BCA | NKG2D | CD28δ | FcγRIII-γ |
| BCA | NKG2D | CD28δ | FcεRIβ |
| BCA | NKG2D | CD28δ | FcεRIγ |
| BCA | NKG2D | CD28δ | DAP10 |
| BCA | NKG2D | CD28δ | DAP12 |
| BCA | NKG2D | CD28δ | CD32 |
| BCA | NKG2D | CD28δ | CD79a |
| BCA | NKG2D | CD28δ | CD79b |
| BCA | NKG2D | CD80 | CD8 |
| BCA | NKG2D | CD80 | CD3ζ |
| BCA | NKG2D | CD80 | CD3δ |
| BCA | NKG2D | CD80 | CD3γ |
| BCA | NKG2D | CD80 | CD3ε |
| BCA | NKG2D | CD80 | FcγRI-γ |
| BCA | NKG2D | CD80 | FcγRIII-γ |
| BCA | NKG2D | CD80 | FcεRIβ |
| BCA | NKG2D | CD80 | FcεRIγ |
| BCA | NKG2D | CD80 | DAP10 |
| BCA | NKG2D | CD80 | DAP12 |
| BCA | NKG2D | CD80 | CD32 |
| BCA | NKG2D | CD80 | CD79a |
| BCA | NKG2D | CD80 | CD79b |
| BCA | NKG2D | CD86 | CD8 |
| BCA | NKG2D | CD86 | CD3ζ |
| BCA | NKG2D | CD86 | CD3δ |
| BCA | NKG2D | CD86 | CD3γ |
| BCA | NKG2D | CD86 | CD3ε |
| BCA | NKG2D | CD86 | FcγRI-γ |
| BCA | NKG2D | CD86 | FcγRIII-γ |
| BCA | NKG2D | CD86 | FcεRIβ |
| BCA | NKG2D | CD86 | FcεRIγ |
| BCA | NKG2D | CD86 | DAP10 |
| BCA | NKG2D | CD86 | DAP12 |
| BCA | NKG2D | CD86 | CD32 |
| BCA | NKG2D | CD86 | CD79a |
| BCA | NKG2D | CD86 | CD79b |
| BCA | NKG2D | OX40 | CD8 |
| BCA | NKG2D | OX40 | CD3ζ |
| BCA | NKG2D | OX40 | CD3δ |
| BCA | NKG2D | OX40 | CD3γ |
| BCA | NKG2D | OX40 | CD3ε |
| BCA | NKG2D | OX40 | FcγRI-γ |
| BCA | NKG2D | OX40 | FcγRIII-γ |
| BCA | NKG2D | OX40 | FcεRIβ |
| BCA | NKG2D | OX40 | FcεRIγ |
| BCA | NKG2D | OX40 | DAP10 |
| BCA | NKG2D | OX40 | DAP12 |
| BCA | NKG2D | OX40 | CD32 |
| BCA | NKG2D | OX40 | CD79a |
| BCA | NKG2D | OX40 | CD79b |
| BCA | NKG2D | DAP10 | CD8 |

TABLE 3-continued

Third Generation CARs

| ScFv | Co-stimulatory Signal | Co-stimulatory Signal | Signal Domain |
|---|---|---|---|
| BCA | NKG2D | DAP10 | CD3ζ |
| BCA | NKG2D | DAP10 | CD3δ |
| BCA | NKG2D | DAP10 | CD3γ |
| BCA | NKG2D | DAP10 | CD3ε |
| BCA | NKG2D | DAP10 | FcγRI-γ |
| BCA | NKG2D | DAP10 | FcγRIII-γ |
| BCA | NKG2D | DAP10 | FcεRIβ |
| BCA | NKG2D | DAP10 | FcεRIγ |
| BCA | NKG2D | DAP10 | DAP10 |
| BCA | NKG2D | DAP10 | DAP12 |
| BCA | NKG2D | DAP10 | CD32 |
| BCA | NKG2D | DAP10 | CD79a |
| BCA | NKG2D | DAP10 | CD79b |
| BCA | NKG2D | DAP12 | CD8 |
| BCA | NKG2D | DAP12 | CD3ζ |
| BCA | NKG2D | DAP12 | CD3δ |
| BCA | NKG2D | DAP12 | CD3γ |
| BCA | NKG2D | DAP12 | CD3ε |
| BCA | NKG2D | DAP12 | FcγRI-γ |
| BCA | NKG2D | DAP12 | FcγRIII-γ |
| BCA | NKG2D | DAP12 | FcεRIβ |
| BCA | NKG2D | DAP12 | FcεRIγ |
| BCA | NKG2D | DAP12 | DAP10 |
| BCA | NKG2D | DAP12 | DAP12 |
| BCA | NKG2D | DAP12 | CD32 |
| BCA | NKG2D | DAP12 | CD79a |
| BCA | NKG2D | DAP12 | CD79b |
| BCA | NKG2D | MyD88 | CD8 |
| BCA | NKG2D | MyD88 | CD3ζ |
| BCA | NKG2D | MyD88 | CD3δ |
| BCA | NKG2D | MyD88 | CD3γ |
| BCA | NKG2D | MyD88 | CD3ε |
| BCA | NKG2D | MyD88 | FcγRI-γ |
| BCA | NKG2D | MyD88 | FcγRIII-γ |
| BCA | NKG2D | MyD88 | FcεRIβ |
| BCA | NKG2D | MyD88 | FcεRIγ |
| BCA | NKG2D | MyD88 | DAP10 |
| BCA | NKG2D | MyD88 | DAP12 |
| BCA | NKG2D | MyD88 | CD32 |
| BCA | NKG2D | MyD88 | CD79a |
| BCA | NKG2D | MyD88 | CD79b |
| BCA | NKG2D | CD7 | CD8 |
| BCA | NKG2D | CD7 | CD3ζ |
| BCA | NKG2D | CD7 | CD3δ |
| BCA | NKG2D | CD7 | CD3γ |
| BCA | NKG2D | CD7 | CD3ε |
| BCA | NKG2D | CD7 | FcγRI-γ |
| BCA | NKG2D | CD7 | FcγRIII-γ |
| BCA | NKG2D | CD7 | FcεRIβ |
| BCA | NKG2D | CD7 | FcεRIγ |
| BCA | NKG2D | CD7 | DAP10 |
| BCA | NKG2D | CD7 | DAP12 |
| BCA | NKG2D | CD7 | CD32 |
| BCA | NKG2D | CD7 | CD79a |
| BCA | NKG2D | CD7 | CD79b |
| BCA | NKG2D | BTNL3 | CD8 |
| BCA | NKG2D | BTNL3 | CD3ζ |
| BCA | NKG2D | BTNL3 | CD3δ |
| BCA | NKG2D | BTNL3 | CD3γ |
| BCA | NKG2D | BTNL3 | CD3ε |
| BCA | NKG2D | BTNL3 | FcγRI-γ |
| BCA | NKG2D | BTNL3 | FcγRIII-γ |
| BCA | NKG2D | BTNL3 | FcεRIβ |
| BCA | NKG2D | BTNL3 | FcεRIγ |
| BCA | NKG2D | BTNL3 | DAP10 |
| BCA | NKG2D | BTNL3 | DAP12 |
| BCA | NKG2D | BTNL3 | CD32 |
| BCA | NKG2D | BTNL3 | CD79a |
| BCA | NKG2D | BTNL3 | CD79b |
| BCA | NKG2D | NKG2D | CD8 |
| BCA | NKG2D | NKG2D | CD3ζ |
| BCA | NKG2D | NKG2D | CD3δ |
| BCA | NKG2D | NKG2D | CD3γ |
| BCA | NKG2D | NKG2D | CD3ε |
| BCA | NKG2D | NKG2D | FcγRI-γ |
| BCA | NKG2D | NKG2D | FcγRIII-γ |
| BCA | NKG2D | NKG2D | FcεRIβ |
| BCA | NKG2D | NKG2D | FcεRIγ |
| BCA | NKG2D | NKG2D | DAP10 |
| BCA | NKG2D | NKG2D | DAP12 |
| BCA | NKG2D | NKG2D | CD32 |
| BCA | NKG2D | NKG2D | CD79a |
| BCA | NKG2D | NKG2D | CD79b |

TABLE 4

CARs lacking Co-Simulatory Signal (for dual CAR approach)

| ScFv | Co-stimulatory Signal | Signal Domain |
|---|---|---|
| BCA | none | CD8 |
| BCA | none | CD3ζ |
| BCA | none | CD3δ |
| BCA | none | CD3γ |
| BCA | none | CD3ε |
| BCA | none | FcγRI-γ |
| BCA | none | FcγRIII-γ |
| BCA | none | FcεRIβ |
| BCA | none | FcεRIγ |
| BCA | none | DAP10 |
| BCA | none | DAP12 |
| BCA | none | CD32 |
| BCA | none | CD79a |
| BCA | none | CD8 |
| BCA | none | CD3ζ |
| BCA | none | CD3δ |
| BCA | none | CD3γ |
| BCA | none | CD3ε |
| BCA | none | FcγRI-γ |

TABLE 5

CARs lacking Signal Domain (for dual CAR approach)

| ScFv | Co-stimulatory Signal | Signal Domain |
|---|---|---|
| BCA | CD28 | none |
| BCA | CD8 | none |
| BCA | CD4 | none |
| BCA | b2c | none |
| BCA | CD137/41BB | none |
| BCA | ICOS | none |
| BCA | CD27 | none |
| BCA | CD28δ | none |
| BCA | CD80 | none |
| BCA | CD86 | none |
| BCA | OX40 | none |
| BCA | DAP10 | none |
| BCA | MyD88 | none |
| BCA | CD7 | none |
| BCA | DAP12 | none |
| BCA | MyD88 | none |
| BCA | CD7 | none |
| BCA | BTNL3 | none |
| BCA | NKG2D | none |

TABLE 6

Third Generation CARs lacking Signal Domain (for dual CAR approach)

| ScFv | Co-stimulatory Signal | Co-stimulatory Signal | Signal Domain |
|---|---|---|---|
| BCA | CD28 | CD28 | none |
| BCA | CD28 | CD8 | none |
| BCA | CD28 | CD4 | none |
| BCA | CD28 | b2c | none |
| BCA | CD28 | CD137/41BB | none |
| BCA | CD28 | ICOS | none |
| BCA | CD28 | CD27 | none |
| BCA | CD28 | CD28δ | none |
| BCA | CD28 | CD80 | none |
| BCA | CD28 | CD86 | none |
| BCA | CD28 | OX40 | none |
| BCA | CD28 | DAP10 | none |
| BCA | CD28 | MyD88 | none |
| BCA | CD28 | CD7 | none |
| BCA | CD28 | DAP12 | none |
| BCA | CD28 | MyD88 | none |
| BCA | CD28 | CD7 | none |
| BCA | CD8 | CD28 | none |
| BCA | CD8 | CD8 | none |
| BCA | CD8 | CD4 | none |
| BCA | CD8 | b2c | none |
| BCA | CD8 | CD137/41BB | none |
| BCA | CD8 | ICOS | none |
| BCA | CD8 | CD27 | none |
| BCA | CD8 | CD28δ | none |
| BCA | CD8 | CD80 | none |
| BCA | CD8 | CD86 | none |
| BCA | CD8 | OX40 | none |
| BCA | CD8 | DAP10 | none |
| BCA | CD8 | MyD88 | none |
| BCA | CD8 | CD7 | none |
| BCA | CD8 | DAP12 | none |
| BCA | CD8 | MyD88 | none |
| BCA | CD8 | CD7 | none |
| BCA | CD4 | CD28 | none |
| BCA | CD4 | CD8 | none |
| BCA | CD4 | CD4 | none |
| BCA | CD4 | b2c | none |
| BCA | CD4 | CD137/41BB | none |
| BCA | CD4 | ICOS | none |
| BCA | CD4 | CD27 | none |
| BCA | CD4 | CD28δ | none |
| BCA | CD4 | CD80 | none |
| BCA | CD4 | CD86 | none |
| BCA | CD4 | OX40 | none |
| BCA | CD4 | DAP10 | none |
| BCA | CD4 | MyD88 | none |
| BCA | CD4 | CD7 | none |
| BCA | CD4 | DAP12 | none |
| BCA | CD4 | MyD88 | none |
| BCA | CD4 | CD7 | none |
| BCA | b2c | CD28 | none |
| BCA | b2c | CD8 | none |
| BCA | b2c | CD4 | none |
| BCA | b2c | b2c | none |
| BCA | b2c | CD137/41BB | none |
| BCA | b2c | ICOS | none |
| BCA | b2c | CD27 | none |
| BCA | b2c | CD28δ | none |
| BCA | b2c | CD80 | none |
| BCA | b2c | CD86 | none |
| BCA | b2c | OX40 | none |
| BCA | b2c | DAP10 | none |
| BCA | b2c | MyD88 | none |
| BCA | b2c | CD7 | none |
| BCA | b2c | DAP12 | none |
| BCA | b2c | MyD88 | none |
| BCA | b2c | CD7 | none |
| BCA | CD137/41BB | CD28 | none |
| BCA | CD137/41BB | CD8 | none |
| BCA | CD137/41BB | CD4 | none |
| BCA | CD137/41BB | b2c | none |
| BCA | CD137/41BB | CD137/41BB | none |
| BCA | CD137/41BB | ICOS | none |
| BCA | CD137/41BB | CD27 | none |
| BCA | CD137/41BB | CD28δ | none |
| BCA | CD137/41BB | CD80 | none |
| BCA | CD137/41BB | CD86 | none |
| BCA | CD137/41BB | OX40 | none |
| BCA | CD137/41BB | DAP10 | none |
| BCA | CD137/41BB | MyD88 | none |
| BCA | CD137/41BB | CD7 | none |
| BCA | CD137/41BB | DAP12 | none |
| BCA | CD137/41BB | MyD88 | none |
| BCA | CD137/41BB | CD7 | none |
| BCA | ICOS | CD28 | none |
| BCA | ICOS | CD8 | none |
| BCA | ICOS | CD4 | none |
| BCA | ICOS | b2c | none |
| BCA | ICOS | CD137/41BB | none |
| BCA | ICOS | ICOS | none |
| BCA | ICOS | CD27 | none |
| BCA | ICOS | CD28δ | none |
| BCA | ICOS | CD80 | none |
| BCA | ICOS | CD86 | none |
| BCA | ICOS | OX40 | none |
| BCA | ICOS | DAP10 | none |
| BCA | ICOS | MyD88 | none |
| BCA | ICOS | CD7 | none |
| BCA | ICOS | DAP12 | none |
| BCA | ICOS | MyD88 | none |
| BCA | ICOS | CD7 | none |
| BCA | ICOS | CD28 | none |
| BCA | ICOS | CD8 | none |
| BCA | ICOS | CD4 | none |
| BCA | ICOS | b2c | none |
| BCA | ICOS | CD137/41BB | none |
| BCA | ICOS | ICOS | none |
| BCA | ICOS | CD27 | none |
| BCA | ICOS | CD28δ | none |
| BCA | ICOS | CD80 | none |
| BCA | ICOS | CD86 | none |
| BCA | ICOS | OX40 | none |
| BCA | ICOS | DAP10 | none |
| BCA | ICOS | MyD88 | none |
| BCA | ICOS | CD7 | none |
| BCA | ICOS | DAP12 | none |
| BCA | ICOS | MyD88 | none |
| BCA | ICOS | CD7 | none |
| BCA | CD27 | CD28 | none |
| BCA | CD27 | CD8 | none |
| BCA | CD27 | CD4 | none |
| BCA | CD27 | b2c | none |
| BCA | CD27 | CD137/41BB | none |
| BCA | CD27 | ICOS | none |
| BCA | CD27 | CD27 | none |
| BCA | CD27 | CD28δ | none |
| BCA | CD27 | CD80 | none |
| BCA | CD27 | CD86 | none |
| BCA | CD27 | OX40 | none |
| BCA | CD27 | DAP10 | none |
| BCA | CD27 | MyD88 | none |
| BCA | CD27 | CD7 | none |
| BCA | CD27 | DAP12 | none |
| BCA | CD27 | MyD88 | none |
| BCA | CD27 | CD7 | none |
| BCA | CD28δ | CD28 | none |
| BCA | CD28δ | CD8 | none |
| BCA | CD28δ | CD4 | none |
| BCA | CD28δ | b2c | none |
| BCA | CD28δ | CD137/41BB | none |
| BCA | CD28δ | ICOS | none |
| BCA | CD28δ | CD27 | none |
| BCA | CD28δ | CD28δ | none |
| BCA | CD28δ | CD80 | none |
| BCA | CD28δ | CD86 | none |
| BCA | CD28δ | OX40 | none |
| BCA | CD28δ | DAP10 | none |
| BCA | CD28δ | MyD88 | none |
| BCA | CD28δ | CD7 | none |

TABLE 6-continued

Third Generation CARs lacking Signal Domain (for dual CAR approach)

| ScFv | Co-stimulatory Signal | Co-stimulatory Signal | Signal Domain |
|---|---|---|---|
| BCA | CD28δ | DAP12 | none |
| BCA | CD28δ | MyD88 | none |
| BCA | CD28δ | CD7 | none |
| BCA | CD80 | CD28 | none |
| BCA | CD80 | CD8 | none |
| BCA | CD80 | CD4 | none |
| BCA | CD80 | b2c | none |
| BCA | CD80 | CD137/41BB | none |
| BCA | CD80 | ICOS | none |
| BCA | CD80 | CD27 | none |
| BCA | CD80 | CD28δ | none |
| BCA | CD80 | CD80 | none |
| BCA | CD80 | CD86 | none |
| BCA | CD80 | OX40 | none |
| BCA | CD80 | DAP10 | none |
| BCA | CD80 | MyD88 | none |
| BCA | CD80 | CD7 | none |
| BCA | CD80 | DAP12 | none |
| BCA | CD80 | MyD88 | none |
| BCA | CD80 | CD7 | none |
| BCA | CD86 | CD28 | none |
| BCA | CD86 | CD8 | none |
| BCA | CD86 | CD4 | none |
| BCA | CD86 | b2c | none |
| BCA | CD86 | CD137/41BB | none |
| BCA | CD86 | ICOS | none |
| BCA | CD86 | CD27 | none |
| BCA | CD86 | CD28δ | none |
| BCA | CD86 | CD80 | none |
| BCA | CD86 | CD86 | none |
| BCA | CD86 | OX40 | none |
| BCA | CD86 | DAP10 | none |
| BCA | CD86 | MyD88 | none |
| BCA | CD86 | CD7 | none |
| BCA | CD86 | DAP12 | none |
| BCA | CD86 | MyD88 | none |
| BCA | CD86 | CD7 | none |
| BCA | OX40 | CD28 | none |
| BCA | OX40 | CD8 | none |
| BCA | OX40 | CD4 | none |
| BCA | OX40 | b2c | none |
| BCA | OX40 | CD137/41BB | none |
| BCA | OX40 | ICOS | none |
| BCA | OX40 | CD27 | none |
| BCA | OX40 | CD28δ | none |
| BCA | OX40 | CD80 | none |
| BCA | OX40 | CD86 | none |
| BCA | OX40 | OX40 | none |
| BCA | OX40 | DAP10 | none |
| BCA | OX40 | MyD88 | none |
| BCA | OX40 | CD7 | none |
| BCA | OX40 | DAP12 | none |
| BCA | OX40 | MyD88 | none |
| BCA | OX40 | CD7 | none |
| BCA | DAP10 | CD28 | none |
| BCA | DAP10 | CD8 | none |
| BCA | DAP10 | CD4 | none |
| BCA | DAP10 | b2c | none |
| BCA | DAP10 | CD137/41BB | none |
| BCA | DAP10 | ICOS | none |
| BCA | DAP10 | CD27 | none |
| BCA | DAP10 | CD28δ | none |
| BCA | DAP10 | CD80 | none |
| BCA | DAP10 | CD86 | none |
| BCA | DAP10 | OX40 | none |
| BCA | DAP10 | DAP10 | none |
| BCA | DAP10 | MyD88 | none |
| BCA | DAP10 | CD7 | none |
| BCA | DAP10 | DAP12 | none |
| BCA | DAP10 | MyD88 | none |
| BCA | DAP10 | CD7 | none |
| BCA | DAP12 | CD28 | none |
| BCA | DAP12 | CD8 | none |
| BCA | DAP12 | CD4 | none |
| BCA | DAP12 | b2c | none |
| BCA | DAP12 | CD137/41BB | none |
| BCA | DAP12 | ICOS | none |
| BCA | DAP12 | CD27 | none |
| BCA | DAP12 | CD28δ | none |
| BCA | DAP12 | CD80 | none |
| BCA | DAP12 | CD86 | none |
| BCA | DAP12 | OX40 | none |
| BCA | DAP12 | DAP10 | none |
| BCA | DAP12 | MyD88 | none |
| BCA | DAP12 | CD7 | none |
| BCA | DAP12 | DAP12 | none |
| BCA | DAP12 | MyD88 | none |
| BCA | DAP12 | CD7 | none |
| BCA | MyD88 | CD28 | none |
| BCA | MyD88 | CD8 | none |
| BCA | MyD88 | CD4 | none |
| BCA | MyD88 | b2c | none |
| BCA | MyD88 | CD137/41BB | none |
| BCA | MyD88 | ICOS | none |
| BCA | MyD88 | CD27 | none |
| BCA | MyD88 | CD28δ | none |
| BCA | MyD88 | CD80 | none |
| BCA | MyD88 | CD86 | none |
| BCA | MyD88 | OX40 | none |
| BCA | MyD88 | DAP10 | none |
| BCA | MyD88 | MyD88 | none |
| BCA | MyD88 | CD7 | none |
| BCA | MyD88 | DAP12 | none |
| BCA | MyD88 | MyD88 | none |
| BCA | MyD88 | CD7 | none |
| BCA | CD7 | CD28 | none |
| BCA | CD7 | CD8 | none |
| BCA | CD7 | CD4 | none |
| BCA | CD7 | b2c | none |
| BCA | CD7 | CD137/41BB | none |
| BCA | CD7 | ICOS | none |
| BCA | CD7 | CD27 | none |
| BCA | CD7 | CD28δ | none |
| BCA | CD7 | CD80 | none |
| BCA | CD7 | CD86 | none |
| BCA | CD7 | OX40 | none |
| BCA | CD7 | DAP10 | none |
| BCA | CD7 | MyD88 | none |
| BCA | CD7 | CD7 | none |
| BCA | CD7 | DAP12 | none |
| BCA | CD7 | MyD88 | none |
| BCA | CD7 | CD7 | none |
| BCA | BTNL3 | CD28 | none |
| BCA | BTNL3 | CD8 | none |
| BCA | BTNL3 | CD4 | none |
| BCA | BTNL3 | b2c | none |
| BCA | BTNL3 | CD137/41BB | none |
| BCA | BTNL3 | ICOS | none |
| BCA | BTNL3 | CD27 | none |
| BCA | BTNL3 | CD28δ | none |
| BCA | BTNL3 | CD80 | none |
| BCA | BTNL3 | CD86 | none |
| BCA | BTNL3 | OX40 | none |
| BCA | BTNL3 | DAP10 | none |
| BCA | BTNL3 | MyD88 | none |
| BCA | BTNL3 | CD7 | none |
| BCA | BTNL3 | DAP12 | none |
| BCA | BTNL3 | MyD88 | none |
| BCA | BTNL3 | CD7 | none |
| BCA | NKG2D | CD28 | none |
| BCA | NKG2D | CD8 | none |
| BCA | NKG2D | CD4 | none |
| BCA | NKG2D | b2c | none |
| BCA | NKG2D | CD137/41BB | none |
| BCA | NKG2D | ICOS | none |
| BCA | NKG2D | CD27 | none |
| BCA | NKG2D | CD28δ | none |
| BCA | NKG2D | CD80 | none |
| BCA | NKG2D | CD86 | none |
| BCA | NKG2D | OX40 | none |

TABLE 6-continued

Third Generation CARs lacking Signal Domain (for dual CAR approach)

| ScFv | Co-stimulatory Signal | Co-stimulatory Signal | Signal Domain |
|---|---|---|---|
| BCA | NKG2D | DAP10 | none |
| BCA | NKG2D | MyD88 | none |
| BCA | NKG2D | CD7 | none |
| BCA | NKG2D | DAP12 | none |
| BCA | NKG2D | MyD88 | none |
| BCA | NKG2D | CD7 | none |

In some embodiments, the anti-BCA binding agent is single chain variable fragment (scFv) antibody. The affinity/specificity of an anti-BCA scFv is driven in large part by specific sequences within complementarity determining regions (CDRs) in the heavy ($V_H$) and light ($V_L$) chain. Each $V_H$ and $V_L$ sequence will have three CDRs (CDR1, CDR2, CDR3).

In some embodiments, the anti-BCA binding agent is derived from natural antibodies, such as monoclonal antibodies. In some cases, the antibody is human. In some cases, the antibody has undergone an alteration to render it less immunogenic when administered to humans. For example, the alteration comprises one or more techniques selected from the group consisting of chimerization, humanization, CDR-grafting, deimmunization, and mutation of framework amino acids to correspond to the closest human germline sequence.

Also disclosed are bi-specific CARs that target a BCA and at least one additional tumor antigen. Also disclosed are CARs designed to work only in conjunction with another CAR that binds a different antigen, such as a tumor antigen. For example, in these embodiments, the endodomain of the disclosed CAR can contain only an signaling domain (SD) or a co-stimulatory signaling region (CSR), but not both. The second CAR (or endogenous T-cell) provides the missing signal if it is activated. For example, if the disclosed CAR contains an SD but not a CSR, then the immune effector cell containing this CAR is only activated if another CAR (or T-cell) containing a CSR binds its respective antigen. Likewise, if the disclosed CAR contains a CSR but not a SD, then the immune effector cell containing this CAR is only activated if another CAR (or T-cell) containing an SD binds its respective antigen.

Tumor antigens are proteins that are produced by tumor cells that elicit an immune response, particularly T-cell mediated immune responses. The additional antigen binding domain can be an antibody or a natural ligand of the tumor antigen. The selection of the additional antigen binding domain will depend on the particular type of cancer to be treated. Tumor antigens are well known in the art and include, for example, a glioma-associated antigen, carcinoembryonic antigen (CEA), EGFRvIII, IL-IIRa, IL-13Ra, EGFR, FAP, B7H3, Kit, CA LX, CS-1, MUC1, BCMA, bcr-abl, HER2, β-human chorionic gonadotropin, alphafetoprotein (AFP), ALK, CD19, TIM3, cyclin BI, lectin-reactive AFP, Fos-related antigen 1, ADRB3, thyroglobulin, EphA2, RAGE-1, RUI, RU2, SSX2, AKAP-4, LCK, OY-TESI, PAX5, SART3, CLL-1, fucosyl GM1, GloboH, MN-CA IX, EPCAM, EVT6-AML, TGS5, human telomerase reverse transcriptase, plysialic acid, PLAC1, RUI, RU2 (AS), intestinal carboxyl esterase, lewisY, sLe, LY6K, mut hsp70-2, M-CSF, MYCN, RhoC, TRP-2, CYPIBI, BORIS, prostate, prostate-specific antigen (PSA), PAX3, PAP, NY-ESO-1, LAGE-Ia, LMP2, NCAM, p53, p53 mutant, Ras mutant, gplOO, prostein, OR51E2, PANX3, PSMA, PSCA, Her2/neu, hTERT, HMWMAA, HAVCR1, VEGFR2, PDGFR-beta, survivin and telomerase, legumain, HPV E6, E7, sperm protein 17, SSEA-4, tyrosinase, TARP, WT1, prostate-carcinoma tumor antigen-1 (PCTA-1), ML-IAP, MAGE, MAGE-A1,MAD-CT-1, MAD-CT-2, MelanA/MART 1, XAGE1, ELF2M, ERG (TMPRSS2 ETS fusion gene), NA17, neutrophil elastase, sarcoma translocation breakpoints, NY-BR-1, ephnnB2, CD20, CD22, CD24, CD30, TIM3, CD38, CD44v6, CD97, CD171, CD179a, androgen receptor, FAP, insulin growth factor (IGF)-I, IGFII, IGF-I receptor, GD2, o-acetyl-GD2, GD3, GM3, GPRC5D, GPR20, CXORF61, folate receptor (FRa), folate receptor beta, ROR1, Flt3, TAG72, TN Ag, Tie 2, TEM1, TEM7R, CLDN6, TSHR, UPK2, and mesothelin. In a preferred embodiment, the tumor antigen is selected from the group consisting of folate receptor (FRa), mesothelin, EGFRvIII, IL-13Ra, CD123, CD19, TIM3, BCMA, GD2, CLL-1, CA-IX, MUCI, HER2, and any combination thereof.

Non-limiting examples of tumor antigens include the following: Differentiation antigens such as tyrosinase, TRP-1, TRP-2 and tumor-specific multilineage antigens such as MAGE-1, MAGE-3, BAGE, GAGE-1, GAGE-2, pi 5; overexpressed embryonic antigens such as CEA; overexpressed oncogenes and mutated tumor-suppressor genes such as p53, Ras, HER-2/neu; unique tumor antigens resulting from chromosomal translocations; such as BCR-ABL, E2A-PRL, H4-RET, IGH-IGK, MYL-RAR; and viral antigens, such as the Epstein Barr virus antigens EBVA and the human papillomavirus (HPV) antigens E6 and E7. Other large, protein-based antigens include TSP-180, MAGE-4, MAGE-5, MAGE-6, RAGE, NY-ESO, pl85erbB2, pl80erbB-3, c-met, nm-23H1, PSA, CA 19-9, CA 72-4, CAM 17.1, NuMa, K-ras, beta-Catenin, CDK4, Mum-1, p 15, p 16, 43-9F, 5T4, 791Tgp72, alpha-fetoprotein, beta-HCG, BCA225, BTAA, CA 125, CA 15-3\CA 27.29\BCAA, CA 195, CA 242, CA-50, CAM43, CD68\P1, CO-029, FGF-5, G250, Ga733\EpCAM, HTgp-175, M344, MA-50, MG7-Ag, MOV18, NB/70K, NY-CO-1, RCASI, SDCCAG1 6, TA-90\Mac-2 binding protein\cyclophilm C-associated protein, TAAL6, TAG72, TLP, TPS, GPC3, MUC16, LMP1, EBMA-1, BARF-1, CS1, CD319, HER1, B7H6, L1CAM, IL6, and MET.

Single Chain Antibodies

CARs generally incorporate an antigen recognition domain from the single-chain variable fragments (scFv) of a monoclonal antibody (mAb) with transmembrane signaling motifs involved in lymphocyte activation (Sadelain M, et al. Nat Rev Cancer 2003 3:35-45).

Anti-CD19 scFv

In some embodiments, the anti-CD19 scFv is derived from hybridoma from plate CD19 Plate 1, CD19 Plate 2, CD19 Plate 3, CD19 Plate 4, CD19 Plate 5, CD19 Plate 6, CD19 Plate 7, CD19 Plate 8, CD19 Plate 9, CD19 Plate 10, CD19 Plate 11, CD19 Plate 12, CD19 Plate 13, CD19 Plate 14, CD19 Plate 15, CD19 Plate 16, CD19 Plate 17, CD19 Plate 18, CD19 Plate 19, CD19 Plate 20, CD19 Plate 21, or CD19 Plate 22. Each plate has 96 wells consisting of 8 columns (A-H) and 12 rows (1-12), so each well contains 96 hybridomas identified by their plate and well, e.g. "CD19 Plate1-A1". In some embodiments, the anti-CD19 scFv can comprise a variable heavy ($V_H$) domain having CDR1, CDR2 and CDR3 sequences and a variable light ($V_L$) domain having CDR1, CDR2 and CDR3 sequences.

In some embodiments, the anti-CD19 scFv can comprise a variable heavy ($V_H$) domain having CDR1, CDR2 and CDR3 sequences and a variable light (V$_L$) domain having CDR1, CDR2 and CDR3 sequences.

For example, in some embodiments, the CDR1 sequence of the V$_H$ domain comprises the amino acid sequence GFTFSSYA (SEQ ID NO:1), GFSLTNFG (SEQ ID NO:2), GYTFTSYW (SEQ ID NO:3), GISITTGNYR (SEQ ID NO:4), GFTFSRYA (SEQ ID NO:5), GYSITSDYA (SEQ ID NO:6), YTFTDYYY (SEQ ID NO:7), or GFSLSRYS (SEQ ID NO:8); CDR2 sequence of the V$_H$ domain comprises the amino acid sequence ISSGGST (SEQ ID NO:9), ISSGGSFT (SEQ ID NO:10), IWRGGST (SEQ ID NO:11), IAPGTGST (SEQ ID NO:12), IYYSGTI (SEQ ID NO:13), ISPGGGYI (SEQ ID NO:14), ISYSGST (SEQ ID NO:15), IYPNNSGT (SEQ ID NO:16), IWVNGNT (SEQ ID NO:17), or IYPGNSDT (SEQ ID NO:18); CDR3 sequence of the V$_H$ domain comprises the amino acid sequence ARGRDGYS-LYFDY (SEQ ID NO:19), AREGVYSDYRAWFAY (SEQ ID NO:20), AKMGITYYFDY (SEQ ID NO:21), AREG-GRYYTLDC (SEQ ID NO:22), ARWLNNFDV (SEQ ID NO:23), AGDYVDY (SEQ ID NO:24), ARNWVYAMDY (SEQ ID NO:25), ARYYDGFNAGFAY (SEQ ID NO:26), ATYYGNYDSFTY (SEQ ID NO:27), or TTSLAY (SEQ ID NO:28); CDR1 sequence of the V$_L$ comprises the amino acid sequence QNVGTN (SEQ ID NO:29), ETIDNYGISF (SEQ ID NO:30), QNVDTN (SEQ ID NO:31), QDVGTA (SEQ ID NO:32), QDVSTA (SEQ ID NO:33), QSLLNSDGKTF (SEQ ID NO:34), QSLLYSSNQKNY (SEQ ID NO:35), QSLLDSDGKTY (SEQ ID NO:36), or SSVSSSY (SEQ ID NO:37); CDR2 sequence of the V$_L$ domain comprises the amino acid sequence SAS (SEQ ID NO:38), GAS (SEQ ID NO:39), WAS (SEQ ID NO:40), LVS (SEQ ID NO:41), or STS (SEQ ID NO:42); and CDR3 sequence of the V$_L$ domain comprises the amino acid sequence QQYNTYPYT (SEQ ID NO:43), QQNKEFPWT (SEQ ID NO:44), QQYN-SYPLT (SEQ ID NO:45), QQYSSYPLT (SEQ ID NO:46), QQHYSTPYT (SEQ ID NO:47), WQGTHFPYT (SEQ ID NO:48), QQYYSYPRT (SEQ ID NO:49), WQGTHFPHT (SEQ ID NO:50), or QQYSGYPLT (SEQ ID NO:51).

The heavy and light chains are preferably separated by a linker. Suitable linkers for scFv antibodies are known in the art. In some embodiments, the linker comprises the amino acid sequence GGGGSGGGGSGGGGS (SEQ ID NO:52).

In some embodiments, the anti-CD19 scFv is derived from hybridoma 1A10, 1H1, 2B1, 2H8, 4A12, 3A10, 4F1, 4H9, 5H5, or 6F10.

Therefore, in some embodiments, the anti-CD19 scFv V$_H$ domain comprises the amino acid sequence:

```
                                   (SEQ ID NO: 53, 1A10)
EVKLEESGGGLVKPGGSLKLSCAASGFTFSSYAMSWVRQTPEKRLEWVA

SISSGGSTYYPDSVKGRFTISRDNARNTLYLQMSSLRSEDTAMYYCARG

RDGYSLYFDYWGQGTTLTVSS.
```

Therefore, in some embodiments, the anti-CD19 scFv V$_H$ domain is encoded by the nucleic acid sequence:

```
                                   (SEQ ID NO: 73, 1A10)
GAAGTGAAGCTGGAGGAGTCTGGGGGAGGCTTAGTGAAGCCTGGAGGGT

CCCTGAAACTCTCCTGTGCAGCCTCTGGATTCACTTTCAGTAGCTATGC

CATGTCTTGGGTTCGCCAGACTCCAGAGAAGAGGCTGGAGTGGGTCGCA

TCCATTAGTAGTGGTGGTAGCACCTACTATCCTGACAGTGTGAAGGGCC
```

GATTCACCATCTCCAGAGATAATGCCAGGAACACCCTGTACCTGCAAAT

GAGCAGTCTGAGGTCTGAGGACACGGCCATGTATTACTGTGCAAGAGGC

CGGGATGGTTACTCCCTTTACTTTGACTACTGGGGCCAAGGCACCACTC

TCACAGTCTCCTCA.

Therefore, in some embodiments, the anti-CD19 scFv V$_H$ domain comprises the amino acid sequence:

```
                                   (SEQ ID NO: 54, 1H1)
QVKLQESGGGLVKPGGSLKLSCAASGFTFSSYAMSWVRQTPEKRLEWV

AGISSGGSFTYYPDTVKGRFTISRDNARNTLYLQMSSLRSEDTAMYSC

AREGVYSDYRAWFAYWGQGTLVTVSG.
```

Therefore, in some embodiments, the anti-CD19 scFv V$_H$ domain is encoded by the nucleic acid sequence:

```
                                   (SEQ ID NO: 74, 1H1)
CAAGTCAAGCTGCAGGAGTCTGGGGGAGGCTTAGTGAAGCCTGGAGGG

TCCCTGAAACTCTCCTGTGCAGCCTCTGGATTCACTTTCAGTAGTTAT

GCCATGTCTTGGGTTCGCCAGACTCCGGAGAAGAGGCTGGAGTGGGTC

GCAGGGATTAGTAGTGGTGGTAGTTTCACTTACTATCCAGACACTGTG

AAGGGACGATTCACCATTTCCAGAGACAATGCCAGGAACACCCTTTAC

CTGCAAATGAGCAGTCTGAGGTCTGAGGACACGGCCATGTATTCCTGT

GCAAGAGAAGGGGTCTATAGTGACTACAGGGCCTGGTTTGCTTACTGG

GGCCAAGGGACTCTGGTCACTGTCTCTGGA.
```

Therefore, in some embodiments, the anti-CD19 scFv V$_H$ domain comprises the amino acid sequence:

```
                                   (SEQ ID NO: 55, 2B1)
EVKLEQSGPSLVQPSQSLSITCTVSGFSLTNFGVHWVRQSPGKGLEWL

GLIWRGGSTDYNAAFMSRLSITKDNSKSQVFFKMNSLQADDTAIYYCA

KMGITYYFDYWGQGTTLTVSS.
```

Therefore, in some embodiments, the anti-CD19 scFv V$_H$ domain is encoded by the nucleic acid sequence:

```
                                   (SEQ ID NO: 75, 2B1)
GAGGTAAAGCTGGAGCAGTCAGGACCTAGCCTAGTGCAGCCCTCACAG

AGCCTGTCCATAACCTGCACAGTCTCTGGTTTCTCATTAACTAACTTT

GGTGTACACTGGGTTCGCCAGTCTCCAGGAAAGGGTCTGGAGTGGCTG

GGACTGATATGGAGAGGTGGAAGCACAGACTACAATGCAGCTTTCATG

TCCAGACTGAGCATCACCAAGGACAACTCCAAGAGCCAAGTTTTCTTT

AAAATGAACAGTCTGCAAGCTGATGACACTGCCATATACTACTGTGCC

AAAATGGGGATTACGTACTACTTTGACTACTGGGGCCAAGGCACCACT

CTCACAGTCTCCTCA.
```

Therefore, in some embodiments, the anti-CD19 scFv V$_H$ domain comprises the amino acid sequence:

(SEQ ID NO: 56, 2H8)
QVKLQQSGDDLVKPGASVKLSCKASGYTFTSYWINWIKQRPGQGLEW

IGHIAPGTGSTYYSEMFKDKATLTVDTPSSSAYIQLSSLSSEDSAVY

FCAREGGRYYTLDCWGQGTSVTVSS.

Therefore, in some embodiments, the anti-CD19 scFv V$_H$ domain is encoded by the nucleic acid sequence:

(SEQ ID NO: 76, 2H8)
CAGGTAAAGCTGCAGCAGTCTGGAGATGATCTGGTAAAGCCTGGGGC

CTCAGTGAAGCTGTCCTGCAAGGCTTCTGGCTACACCTTCACCAGCT

ACTGGATTAACTGGATAAAACAGAGGCCTGGACAGGGCCTTGAGTGG

ATAGGACATATTGCTCCTGGAACTGGTAGTACTTACTACAGTGAAAT

GTTCAAGGACAAGGCAACACTGACTGTAGACACACCCTCCAGCTCAG

CCTACATTCAGCTCAGCAGCCTGTCATCTGAGGACTCTGCTGTCTAT

TTCTGTGCAAGAGAGGGGGACGATACTATACTTTGGACTGCTGGGG

TCAAGGAACCTCAGTCACCGTCTCCTCA.

Therefore, in some embodiments, the anti-CD19 scFv V$_H$ domain comprises the amino acid sequence:

(SEQ ID NO: 57, 4A12)
QVQLEESGPGLVKPSQTVSLTCTVTGISITTGNYRWSWIRQFPGNKL

EWIGYIYYSGTITYNPSLTSRTTITRDTSKNQFFLEMNSLTAEDTAT

YYCARWLNNFDVWGTGTTVTVS.

Therefore, in some embodiments, the anti-CD19 scFv V$_H$ domain is encoded by the nucleic acid sequence:

(SEQ ID NO: 77, 4A12)
CAGGTGCAGCTGGAGGAGTCAGGACCTGGTCTGGTGAAACCTTCTCAG

ACAGTGTCCCTCACCTGCACTGTCACTGGCATCTCCATCACCACTGGA

AATTACAGATGGAGCTGGATCCGGCAGTTTCCAGGAAACAAACTGGAG

TGGATAGGGTACATATACTACAGTGGTACCATTACCTACAATCCATCT

CTCACAAGTCGAACCACCATCACTAGAGACACTTCCAAGAACCAATTC

TTCCTGGAAATGAACTCTTTGACTGCTGAAGACACAGCCACATACTAC

TGTGCACGATGGTTAAACAACTTCGATGTCTGGGGCACAGGGACCACG

GTCACCGTCTCCTCA.

Therefore, in some embodiments, the anti-CD19 scFv V$_H$ domain comprises the amino acid sequence:

(SEQ ID NO: 58, 3A10)
EVMLVESGGGLVKPGGSLKLSCAASGFTFSRYAMSWNRQTPEKRLEW

VATISPGGGYIYYSDSVKGRFTISRDNARNTLYLQMSSLRSEDTAMY

YCAGDYVDYWGQGTTLTVSS.

Therefore, in some embodiments, the anti-CD19 scFv V$_H$ domain is encoded by the nucleic acid sequence:

(SEQ ID NO: 78, 3A10)
GAAGTGATGCTGGTGGAATCTGGGGGAGGCTTAGTGAAGCCTGGAGGG

TCCCTGAAACTCTCCTGTGCAGCCTCTGGATTCACTTTCAGTAGGTAT

GCCATGTCTTGGAATCGCCAGACTCCGGAGAAGAGGCTGGAGTGGGTC

GCAACAATTAGTCCTGGTGGTGGTTACATATACTATTCAGACAGTGTG

AAGGGGCGATTCACCATCTCCAGAGACAATGCCAGGAACACCCTGTAT

CTGCAAATGAGCAGTCTGAGGTCTGAGGACACGGCCATGTATTACTGT

GCAGGGGACTATGTTGACTATTGGGGCCAAGGCACCACTCTCACAGTC

TCCTCA.

Therefore, in some embodiments, the anti-CD19 scFv V$_H$ domain comprises the amino acid sequence:

(SEQ ID NO: 59, 4F1)
QVQLQESGPGLVKPSQSLSLTCTVTGYSITSDYAWNWIRQFPGNKLE

WMGYISYSGSTTYNPSLKGRISFTRDTSKNQFFLHLKSVTTEDSATY

YCARNWVYAMDYWGQGTSVTVSS.

Therefore, in some embodiments, the anti-CD19 scFv V$_H$ domain is encoded by the nucleic acid sequence:

(SEQ ID NO: 79, 4F1)
CAAGTTCAGCTGCAGGAGTCGGGACCTGGCCTGGTAAAACCTTCTCA

GTCTCTGTCCCTCACCTGCACTGTCACTGGCTACTCAATCACCAGTG

ATTATGCCTGGAACTGGATCCGGCAGTTTCCAGGAAACAAACTGGAG

TGGATGGGCTACATAAGCTACAGTGGTAGCACTACCTACAACCCATC

TCTCAAAGGTCGAATCTCTTTCACTCGAGACACCTCCAAGAACCAGT

TCTTCCTGCACTTGAAATCTGTGACTACTGAGGACTCAGCCACATAT

TACTGTGCAAGAAACTGGGTCTATGCTATGGACTACTGGGGTCAAGG

AACCTCAGTCACCGTCTCCTCA.

Therefore, in some embodiments, the anti-CD19 scFv V$_H$ domain comprises the amino acid sequence:

(SEQ ID NO: 60, 4H9)
EVKLQQSGPVLVKPGASVKISCKASGYTFTDYYYMNWVKQSHGKSL

EWIGYIYPNNSGTSYNQKFRGKATLTVDKSSSTAYMEVRSLTSEDS

AVYYCARYYDGFNAGFAYWGQGTLVTVSA.

Therefore, in some embodiments, the anti-CD19 scFv V$_H$ domain is encoded by the nucleic acid sequence:

(SEQ ID NO: 80, 4H9)
GAGGTAAAGCTGCAGCAGTCTGGACCTGTACTGGTGAAGCCTGGGGC

TTCAGTGAAGATATCCTGCAAGGCTTCTGGATACACATTCACTGACT

ACTACTACATGAATTGGGTGAAGCAGAGCCATGGAAAGAGCCTTGAG

TGGATTGGATATATTTATCCTAACAATAGTGGTACTAGTTACAACCA

GAAGTTCAGGGGCAAGGCCACATTGACTGTTGACAAGTCCTCCAGCA

CAGCCTACATGGAGGTCCGCAGCCTGACATCTGAGGATTCTGCAGTC

-continued
TATTACTGTGCGAGATACTATGATGGTTTCAACGCCGGGTTTGCTTA

CTGGGGCCAAGGGACTCTGGTCACTGTCTCTGCA.

Therefore, in some embodiments, the anti-CD19 scFv $V_H$ domain comprises the amino acid sequence:

(SEQ ID NO: 61, 5H5)
QVQLEESGPGLVAPSQSLSITCTVSGFSLSRYSVHWVRQPPGKGLEWLG

MIWVNGNTDYNSALKSRLNINKDNSKSQVFLKMNSLQTDDTAMYYCATY

YGNYDSFTYWGQGTLVTVSA.

Therefore, in some embodiments, the anti-CD19 scFv $V_H$ domain is encoded by the nucleic acid sequence:

(SEQ ID NO: 81, 5H5)
CAAGTGCAGCTGGAGGAGTCAGGACCTGGCCTGGTGGCACCCTCACAGA

GCCTGTCCATCACATGCACTGTCTCTGGGTTCTCATTATCCAGATATAG

TGTACACTGGGTTCGCCAGCCTCCAGGAAAGGGTCTGGAATGGCTGGGA

ATGATATGGGTTAATGGAAACACAGACTATAATTCAGCTCTCAAATCCA

GACTTAACATCAACAAGGACAACTCCAAGAGCCAAGTTTTCTTAAAAAT

GAACAGTCTGCAAACTGATGACACAGCCATGTACTATTGTGCCACCTAT

TATGGAAACTACGATTCCTTTACTTACTGGGGCCAGGGGACTCTGGTCA

CTGTCTCTGCA.

Therefore, in some embodiments, the anti-CD19 scFv $V_H$ domain comprises the amino acid sequence:

(SEQ ID NO: 62, 6F10)
EVQLQESGAELARPGASVKMSCKASGYTFTSYWMHWVKQRPGQGLEWIG

AIYPGNSDTSYNQKFKGKAKLTAVTSASTAYMELSSLTNEDSAVYYCTT

SLAYWGQGTLVTVSA.

Therefore, in some embodiments, the anti-CD19 scFv $V_H$ domain is encoded by the nucleic acid sequence:

(SEQ ID NO: 82, 6F10)
GAGGTGCAGCTGCAGGAGTCTGGGGCTGAGCTGGCAAGACCTGGGGCTT

CAGTGAAGATGTCCTGCAAGGCTTCTGGCTACACCTTTACCAGCTACTG

GATGCACTGGGTAAAACAGAGGCCTGGACAGGGTCTGGAATGGATTGGC

GCTATTTATCCTGGAAATAGTGATACTAGCTACAATCAGAAGTTCAAGG

GCAAGGCCAAACTGACTGCAGTCACATCCGCCAGCACTGCCTACATGGA

GCTCAGCAGCCTAACAAATGAGGACTCTGCGGTCTATTACTGTACAACC

TCCCTTGCTTACTGGGGCCAAGGGACTCTGGTCACTGTCTCTGCA.

In some embodiments, the anti-CD19 scFv $V_L$ domain comprises the amino acid sequence:

(SEQ ID NO: 63, 1A10)
DIVLTQSHKFMSTSVGDRVSVTCKASQNVGTNVAWYQQKPGQSPKALIF

SASYRNSGVPDRFTGSGSGTDFTLTITNVQSEDLLEYFCQQYNTYPYTF

GGGTKLEIKR.

In some embodiments, the anti-CD19 scFv $V_L$ domain encoded by the nucleic acid sequence:

(SEQ ID NO: 83, 1A10)
GATATTGTGCTGACCCAATCTCACAAATTCATGTCCACATCAGTTGGAG

ACAGGGTCAGCGTCACCTGCAAGGCCAGTCAGAATGTGGGTACTAATGT

AGCCTGGTATCAACAGAAACCAGGGCAATCTCCTAAAGCACTGATTTTC

TCGGCATCCTACCGGAACAGTGGAGTCCCTGATCGCTTCACAGGCAGTG

GATCTGGGACAGATTTCACTCTCACCATCACCAATGTGCAGTCTGAAGA

CTTGTTAGAGTATTTCTGTCAGCAATATAACACCTATCCGTACACGTTC

GGAGGGGGGACCAAGCTGGAAATAAAACGG.

In some embodiments, the anti-CD19 scFv $V_L$ domain comprises the amino acid sequence:

(SEQ ID NO: 64, 1H1)
DIVMTQSPASLAVSLGQRATISCRASETIDNYGISFMNWFQQKPGQPPK

LLIYGASNQGSGVPARFSGSGSGTDFSLNIHPMEEDDTAMYFCQQNKEF

PWTFGGGTKLEIKR.

In some embodiments, the anti-CD19 scFv $V_L$ domain encoded by the nucleic acid sequence:

(SEQ ID NO: 84, 1H1)
GATATTGTGATGACCCAATCTCCAGCTTCTTTGGCTGTGTCTCTAGGAC

AGAGGGCCACCATCTCCTGCAGAGCCAGCGAAACTATTGATAATTATGG

CATTAGTTTTATGAACTGGTTCCAACAGAAACCAGGACAGCCACCCAAG

CTCCTCATCTATGGTGCATCCAACCAAGGATCCGGGGTCCCTGCCAGGT

TTAGTGGCAGTGGGTCTGGGACAGACTTCAGCCTCAACATCCATCCTAT

GGAGGAGGATGATACTGCAATGTATTTCTGTCAGCAAAATAAGGAATTT

CCGTGGACGTTCGGTGGAGGCACCAAGCTGGAAATCAAACGG.

In some embodiments, the anti-CD19 scFv $V_L$ domain comprises the amino acid sequence:

(SEQ ID NO: 65, 2B1)
DIVMTQSHKFMSTSVGGRVSVTCKASQNVDTNVAWYQQKPGQSPKALIY

SASYRYSGVPDRFTGSGSGTDFTLTITNVQSEDLAEYFCQQYNSYPLTF

GAGTKLELKR.

In some embodiments, the anti-CD19 scFv $V_L$ domain encoded by the nucleic acid sequence:

(SEQ ID NO: 85, 2B1)
GACATTGTGATGACCCAATCTCACAAATTCATGTCCACATCAGTAGGAG

GCAGGGTCAGTGTCACCTGCAAGGCCAGTCAGAATGTGGATACTAATGT

AGCCTGGTATCAACAGAAACCAGGGCAATCTCCTAAAGCACTGATTTAC

TCGGCATCGTACCGGTACAGTGGAGTCCCTGATCGCTTCACAGGCAGTG

GATCTGGGACAGATTTCACTCTCACCATCACTAATGTGCAGTCTGAAGA

CTTGGCAGAGTATTTCTGTCAGCAATATAACAGCTATCCGCTCACGTTC

GGTGCTGGGACCAAGCTGGAGCTGAAACGG.

In some embodiments, the anti-CD19 scFv $V_L$ domain comprises the amino acid sequence:

(SEQ ID NO: 66, 2H8)
DIVLTQTHKFMSTSVGDRVSITCKASQDVGTAVAWYQQKPGQSPKLLIY
WASTRHTGVPDRFTGSGSGTDFTLTISNVQSEDLADYFCQQYSSYPLTF
GGGTKLEIKR.

In some embodiments, the anti-CD19 scFv $V_L$ domain encoded by the nucleic acid sequence:

(SEQ ID NO: 86, 2H8)
GACATTGTGCTCACACAGACTCACAAATTCATGTCCACATCAGTAGGAG
ACAGGGTCAGCATCACCTGCAAGGCCAGTCAGGATGTGGGTACTGCTGT
AGCCTGGTATCAACAGAAACCAGGGCAATCTCCTAAACTACTGATTTAC
TGGGCATCCACCCGGCACACTGGAGTCCCTGATCGCTTCACAGGCAGTG
GATCTGGGACAGATTTCACTCTCACCATTAGCAATGTGCAGTCTGAAGA
CTTGGCAGATTATTTCTGTCAGCAATATAGCAGCTATCCTCTCACGTTC
GGAGGGGGGACCAAGCTGGAAATAAAACGG.

In some embodiments, the anti-CD19 scFv $V_L$ domain comprises the amino acid sequence:

(SEQ ID NO: 67, 4A12)
DIVITQSHKFMPTSVGDRVSITCKASQDVSTAVAWYQQKPGQSPKLLIY
SASYRYTGVPDRFTGSGSGTDFTFTISSVQAEDLAVYYCQQHYSTPYTF
GGGTKLEIKR.

In some embodiments, the anti-CD19 scFv $V_L$ domain encoded by the nucleic acid sequence:

(SEQ ID NO: 87, 4A12)
GACATTGTGATCACACAATCTCACAAATTCATGCCCACATCAGTAGGAG
ACAGGGTCAGCATCACCTGCAAGGCCAGTCAGGATGTGAGTACTGCTGT
AGCCTGGTATCAACAGAAACCAGGACAATCTCCTAAACTACTGATTTAC
TCGGCATCCTACCGGTACACTGGAGTCCCTGATCGCTTCACTGGCAGTG
GATCTGGGACGGATTTCACTTTCACCATCAGCAGTGTGCAGGCTGAAGA
CCTGGCAGTTTATTACTGTCAGCAACATTATAGTACTCCGTACACGTTC
GGAGGGGGGACCAAGCTGGAAATAAAACGG.

In some embodiments, the anti-CD19 scFv $V_L$ domain comprises the amino acid sequence:

(SEQ ID NO: 68, 3A10)
DWMTQTPLTLSVTTGQPASISCKSSQSLLNSDGKTFLNWLLQRPGQSPK
RLIYLVSKLDSGVPDRFTGSGSGTDFTLKICRVEAEDLGVYYCWQGTHF
PYTFGGGTKLEIKR.

In some embodiments, the anti-CD19 scFv $V_L$ domain encoded by the nucleic acid sequence:

(SEQ ID NO: 88, 3A10)
GATGTTGTGATGACCCAGACTCCACTCACTTTGTCGGTTACCACTGGACA
ACCAGCCTCCATCTCTTGCAAGTCAAGTCAGAGCCTCTTAAATAGTGATG
GAAAGACATTTTTGAATTGGTTGTTACAGAGGCCAGGGCAGTCTCCAAAG
CGCCTAATCTATCTGGTGTCTAAACTGGACTCTGGAGTCCCTGACAGGTT
CACTGGCAGTGGATCAGGGACAGATTTCACACTGAAAATCTGCAGAGTGG
AGGCTGAGGATTTGGGAGTTTATTATTGCTGGCAAGGTACACATTTTCCA
TACACGTTCGGAGGGGGGACCAAGCTGGAAATAAAACGG.

In some embodiments, the anti-CD19 scFv $V_L$ domain comprises the amino acid sequence:

(SEQ ID NO: 69, 4F1)
DIVMSQSPSSLAVSVGEKVTMSCKSSQSLLYSSNQKNYLAWYQQKPGQSP
KLLIYWASTRESGVPDRFTGSGSGTDFTLTISSVKAEDLAVYYCQQYYSY
PRTFGGGTKLEIKR.

In some embodiments, the anti-CD19 scFv $V_L$ domain encoded by the nucleic acid sequence:

(SEQ ID NO: 89, 4F1)
GACATTGTGATGTCACAGTCTCCATCCTCCCTAGCTGTGTCAGTTGGAGA
GAAGGTTACTATGAGCTGCAAGTCCAGTCAGAGCCTTTTATATAGTAGCA
ATCAAAAGAACTACTTGGCCTGGTACCAGCAGAAACCAGGGCAGTCTCCT
AAACTGCTGATTTACTGGGCATCCACTAGGGAATCTGGGGTCCCTGATCG
CTTCACAGGCAGTGGATCTGGGACAGATTTCACTCTCACCATCAGCAGTG
TGAAGGCTGAAGACCTGGCAGTTTATTACTGTCAGCAATATTATAGCTAT
CCTCGGACGTTCGGTGGAGGCACCAAGCTGGAAATCAAACGG.

In some embodiments, the anti-CD19 scFv $V_L$ domain comprises the amino acid sequence:

(SEQ ID NO: 70, 4H9)
DIVLTQSTSSLAVSVGEKVTMSCKSSQSLLFGSNQKNYLAWYQQKLGQSP
KLLIFWASTRESGVPDRFTGSGSGTDFTLTISSVKAEDLAVYYCQQYYSY
PFTFGSGTKLEIKR.

In some embodiments, the anti-CD19 scFv $V_L$ domain encoded by the nucleic acid sequence:

(SEQ ID NO: 90, 4H9)
GACATTGTGCTGACCCAATCTACATCCTCCCTAGCTGTGTCAGTTGGAGA
GAAGGTTACTATGAGCTGCAAGTCCAGTCAGAGCCTTTTATTTGGTAGCA
ATCAAAAGAACTACTTGGCCTGGTACCAGCAGAAATTAGGGCAGTCTCCT
AAACTACTAATTTTCTGGGCATCCACTAGGGAATCTGGGGTCCCTGATCG
CTTCACAGGCAGTGGATCTGGGACAGATTTCACTCTCACCATCAGCAGTG
TGAAGGCTGAAGACCTGGCAGTTTATTACTGTCAGCAATATTATAGCTAT
CCATTCACGTTCGGCTCGGGGACAAAGTTGGAAATAAAACGG.

In some embodiments, the anti-CD19 scFv V$_L$ domain comprises the amino acid sequence:

(SEQ ID NO: 71, 5H5)
DIVLTQTNLTLSITIGQPASISCKSSQSLLDSDGKTYLNWLLQRPGQSPK
RLIYLVSKLDSGVPDRFTGSGSGTDFTLKISRVGAEDLGIYYCWQGTHFP
HTFGGGTKLEIKR.

In some embodiments, the anti-CD19 scFv V$_L$ domain encoded by the nucleic acid sequence:

(SEQ ID NO: 91, 5H5)
GATATTGTGCTCACCCAGACTAACCTCACTTTGTCGATTACCATTGGACA
ACCAGCCTCCATCTCTTGCAAGTCAAGTCAGAGCCTCTTAGATAGTGATG
GAAAGACATATTTGAATTGGTTGTTACAGAGGCCAGGCCAGTCTCCAAAG
CGCCTAATCTATCTGGTGTCTAAACTGGACTCTGGAGTCCCTGACAGGTT
CACTGGCAGTGGATCAGGGACAGATTTCACACTGAAAATCAGCAGAGTGG
GGGCTGAGGATTTGGGAATTTATTATTGCTGGCAAGGTACACATTTTCCT
CACACGTTCGGAGGGGGGACCAAGCTGGAAATAAAACGG.

In some embodiments, the anti-CD19 scFv V$_L$ domain comprises the amino acid sequence:

(SEQ ID NO: 72, 6F10)
DIVLTQSPAIMSASPGEKVTMTCRASSSVSSSYLHWYQQKSGASPKLWIY
STSNLASGVPARFSGSGSGTSYSLTISSVEAEDAATYYCQQYSGYPLTFG
AGTKLELKR.

In some embodiments, the anti-CD19 scFv V$_L$ domain encoded by the nucleic acid sequence:

(SEQ ID NO: 92, 6F10)
GATATTGTGCTGACCCAGTCTCCAGCAATCATGTCTGCATCTCCAGGGGA
AAAGGTCACCATGACCTGCAGGGCCAGCTCAAGTGTAAGTTCCAGTTACT
TGCACTGGTACCAGCAGAAGTCAGGTGCCTCCCCCAAACTCTGGATTTAT
AGCACATCCAACTTGGCTTCTGGAGTCCCTGCTCGCTTCAGTGGCAGTGG
GTCTGGGACCTCTTACTCTCTCACAATCAGCAGTGTGGAGGCTGAAGATG
CTGCCACTTATTACTGCCAGCAGTACAGTGGTTACCCACTCACGTTCGGT
GCTGGGACCAAGCTGGAGCTGAAACGG.

In some embodiments, the anti-CD19 scFv comprises an amino acid sequence:

(SEQ ID NO: 93)
EVKLEESGGGLVKPGGSLKLSCAASGFTFSSYAMSWVRQTPEKRLEWVAS
ISSGGSTYYPDSVKGRFTISRDNARNTLYLQMSSLRSEDTAMYYCARGRD
GYSLYFDYWGQGTTLTVSSGGGGSGGGGSGGGGSDIVLTQSHKFMSTSVG
DRVSVTCKASQNVGTNVAWYQQKPGQSPKALIFSASYRNSGVPDRFTGSG
SGTDFTLTITNVQSEDLLEYFCQQYNTYPYTFGGGTKLEIKR.

In some embodiments, the anti-CD19 scFv comprises an amino acid sequence:

(SEQ ID NO: 94)
EVKLEESGGGLVKPGGSLKLSCAASGFTFSSYAMSWVRQTPEKRLEWVAS
ISSGGSTYYPDSVKGRFTISRDNARNTLYLQMSSLRSEDTAMYYCARGRD
GYSLYFDYWGQGTTLTVSSGGGGSGGGGSGGGGSDIVMTQSPASLAVSLG
QRATISCRASETIDNYGISFMNWFQQKPGQPPKLLIYGASNQGSGVPARF
SGSGSGTDFSLNIHPMEEDDTAMYFCQQNKEFPWTFGGGTKLEIK.

In some embodiments, the anti-CD19 scFv comprises an amino acid sequence:

(SEQ ID NO: 95)
EVKLEESGGGLVKPGGSLKLSCAASGFTFSSYAMSWVRQTPEKRLEWVAS
ISSGGSTYYPDSVKGRFTISRDNARNTLYLQMSSLRSEDTAMYYCARGRD
GYSLYFDYWGQGTTLTVSSGGGGSGGGGSGGGGSDIVMTQSHKFMSTSVG
GRVSVTCKASQNVDTNVAWYQQKPGQSPKALIYSASYRYSGVPDRFTGSG
SGTDFTLTITNVQSEDLAEYFCQQYNSYPLTFGAGTKLELKR.

In some embodiments, the anti-CD19 scFv comprises an amino acid sequence:

(SEQ ID NO: 96)
EVKLEESGGGLVKPGGSLKLSCAASGFTFSSYAMSWVRQTPEKRLEWVAS
ISSGGSTYYPDSVKGRFTISRDNARNTLYLQMSSLRSEDTAMYYCARGRD
GYSLYFDYWGQGTTLTVSSGGGGSGGGGSGGGGSDIVLTQTHKFMSTSVG
DRVSITCKASQDVGTAVAWYQQKPGQSPKLLIYWASTRHTGVPDRFTGSG
SGTDFTLTISNVQSEDLADYFCQQYSSYPLTFGGGTKLEIKR.

In some embodiments, the anti-CD19 scFv comprises an amino acid sequence:

(SEQ ID NO: 97)
EVKLEESGGGLVKPGGSLKLSCAASGFTFSSYAMSWVRQTPEKRLEWVAS
ISSGGSTYYPDSVKGRFTISRDNARNTLYLQMSSLRSEDTAMYYCARGRD
GYSLYFDYWGQGTTLTVSSGGGGSGGGGSGGGGSDIVITQSHKFMPTSVG
DRVSITCKASQDVSTAVAWYQQKPGQSPKLLIYSASYRYTGVPDRFTGSG
SGTDFTFTISSVQAEDLAVYYCQQHYSTPYTFGGGTKLEIKR.

In some embodiments, the anti-CD19 scFv comprises an amino acid sequence:

(SEQ ID NO: 98)
EVKLEESGGGLVKPGGSLKLSCAASGFTFSSYAMSWVRQTPEKRLEWVAS
ISSGGSTYYPDSVKGRFTISRDNARNTLYLQMSSLRSEDTAMYYCARGRD
GYSLYFDYWGQGTTLTVSSGGGGGGGGSGGGGSDVVMTQTPLTLSVTTGQ
PASISCKSSQSLLNSDGKTFLNWLLQRPGQSPKRLIYLVSKLDSGVPDRF
TGSGSGTDFTLKICRVEAEDLGVYYCWQGTHFPYTFGGGTKLEIKR.

In some embodiments, the anti-CD19 scFv comprises an amino acid sequence:

(SEQ ID NO: 99)
EVKLEESGGGLVKPGGSLKLSCAASGFTFSSYAMSWVRQTPEKRLEWVA
SISSGGSTYYPDSVKGRFTISRDNARNTLYLQMSSLRSEDTAMYYCARG
RDGYSLYFDYWGQGTTLTVSSGGGGSGGGGSGGGGSDIVMSQSPSSLAV
SVGEKVTMSCKSSQSLLYSSNQKNYLAWYQQKPGQSPKLLIYWASTRES
GVPDRFTGSGSGTDFTLTISSVKAEDLAVYYCQQYYSYPRTFGGGTKLE
IKR.

In some embodiments, the anti-CD19 scFv comprises an amino acid sequence:

(SEQ ID NO: 100)
EVKLEESGGGLVKPGGSLKLSCAASGFTFSSYAMSWVRQTPEKRLEWVA
SISSGGSTYYPDSVKGRFTISRDNARNTLYLQMSSLRSEDTAMYYCARG
RDGYSLYFDYWGQGTTLTVSSGGGGSGGGGSGGGGSDIVLTQSTSSLAV
SVGEKVTMSCKSSQSLLFGSNQKNYLAWYQQKLGQSPKLLIFWASTRES
GVPDRFTGSGSGTDFTLTISSVKAEDLAVYYCQQYYSYPFTFGSGTKLE
IKR.

In some embodiments, the anti-CD19 scFv comprises an amino acid sequence:

(SEQ ID NO: 101)
EVKLEESGGGLVKPGGSLKLSCAASGFTFSSYAMSWVRQTPEKRLEWVA
SISSGGSTYYPDSVKGRFTISRDNARNTLYLQMSSLRSEDTAMYYCARG
RDGYSLYFDYWGQGTTLTVSSGGGGSGGGGSGGGGSDIVLTQTNLTLSI
TIGQPASISCKSSQSLLDSDGKTYLNWLLQRPGQSPKRLIYLVSKLDSG
VPDRFTGSGSGTDFTLKISRVGAEDLGIYYCWQGTHFPHTFGGGTKLEI
KR.

In some embodiments, the anti-CD19 scFv comprises an amino acid sequence:

(SEQ ID NO: 102)
EVKLEESGGGLVKPGGSLKLSCAASGFTFSSYAMSWVRQTPEKRLEWVA
SISSGGSTYYPDSVKGRFTISRDNARNTLYLQMSSLRSEDTAMYYCARG
RDGYSLYFDYWGQGTTLTVSSGGGGSGGGGSGGGGSDIVLTQSPAIMSA
SPGEKVTMTCRASSSVSSSYLHWYQQKSGASPKLWIYSTSNLASGVPAR
FSGSGSGTSYSLTISSVEAEDAATYYCQQYSGYPLTFGAGTKLELKR.

In some embodiments, the anti-CD19 scFv comprises an amino acid sequence:

(SEQ ID NO: 103)
QVKLQESGGGLVKPGGSLKLSCAASGFTFSSYAMSWVRQTPEKRLEWVA
GISSGGSFTYYPDTVKGRFTISRDNARNTLYLQMSSLRSEDTAMYSCAR
EGVYSDYRAWFAYWGQGTLVTVSGGGGGSGGGGSGGGGSDIVLTQSHKF
MSTSVGDRVSVTCKASQNVGTNVAWYQQKPGQSPKALIFSASYRNSGVP
DRFTGSGSGTDFTLTITNVQSEDLLEYFCQQYNTYPYTFGGGTKLEIKR.

In some embodiments, the anti-CD19 scFv comprises an amino acid sequence:

(SEQ ID NO: 104)
QVKLQESGGGLVKPGGSLKLSCAASGFTFSSYAMSWVRQTPEKRLEWVA
GISSGGSFTYYPDTVKGRFTISRDNARNTLYLQMSSLRSEDTAMYSCAR
EGVYSDYRAWFAYWGQGTLVTVSGGGGGSGGGGSGGGGSDIVMTQSPAS
LAVSLGQRATISCRASETIDNYGISFMNWFQQKPGQPPKLLIYGASNQG
SGVPARFSGSGSGTDFSLNIHPMEEDDTAMYFCQQNKEFPWTFGGGTKL
EIK.

In some embodiments, the anti-CD19 scFv comprises an amino acid sequence:

(SEQ ID NO: 105)
QVKLQESGGGLVKPGGSLKLSCAASGFTFSSYAMSWVRQTPEKRLEWVA
GISSGGSFTYYPDTVKGRFTISRDNARNTLYLQMSSLRSEDTAMYSCAR
EGVYSDYRAWFAYWGQGTLVTVSGGGGGSGGGGSGGGGSDIVMTQSHKF
MSTSVGGRVSVTCKASQNVDTNVAWYQQKPGQSPKALIYSASYRYSGVP
DRFTGSGSGTDFTLTITNVQSEDLAEYFCQQYNSYPLTFGAGTKLELKR.

In some embodiments, the anti-CD19 scFv comprises an amino acid sequence:

(SEQ ID NO: 106)
QVKLQESGGGLVKPGGSLKLSCAASGFTFSSYAMSWVRQTPEKRLEWVA
GISSGGSFTYYPDTVKGRFTISRDNARNTLYLQMSSLRSEDTAMYSCAR
EGVYSDYRAWFAYWGQGTLVTVSGGGGGSGGGGSGGGGSDIVLTQTHKF
MSTSVGDRVSITCKASQDVGTAVAWYQQKPGQSPKLLIYWASTRHTGVP
DRFTGSGSGTDFTLTISNVQSEDLADYFCQQYSSYPLTFGGGTKLEIKR.

In some embodiments, the anti-CD19 scFv comprises an amino acid sequence:

(SEQ ID NO: 107)
QVKLQESGGGLVKPGGSLKLSCAASGFTFSSYAMSWVRQTPEKRLEWVA
GISSGGSFTYYPDTVKGRFTISRDNARNTLYLQMSSLRSEDTAMYSCAR
EGVYSDYRAWFAYWGQGTLVTVSGGGGGSGGGGSGGGGSDIVITQSHKF
MPTSVGDRVSITCKASQDVSTAVAWYQQKPGQSPKLLIYSASYRYTGVP
DRFTGSGSGTDFTFTISSVQAEDLAVYYCQHYSTPYTFGGGTKLEIKR.

In some embodiments, the anti-CD19 scFv comprises an amino acid sequence:

(SEQ ID NO: 108)
QVKLQESGGGLVKPGGSLKLSCAASGFTFSSYAMSWVRQTPEKRLEWVA
GISSGGSFTYYPDTVKGRFTISRDNARNTLYLQMSSLRSEDTAMYSCAR
EGVYSDYRAWFAYWGQGTLVTVSGGGGGSGGGGSGGGGSDVVMTQTPLT

-continued

LSVTTGQPASISCKSSQSLLNSDGKTFLNWLLQRPGQSPKRLIYLVSKL

DSGVPDRFTGSGSGTDFTLKICRVEAEDLGVYYCWQGTHFPYTFGGGTK

LEIKR.

In some embodiments, the anti-CD19 scFv comprises an amino acid sequence:

(SEQ ID NO: 109)
QVKLQESGGGLVKPGGSLKLSCAASGFTFSSYAMSWVRQTPEKRLEWVA

GISSGGSFTYYPDTVKGRFTISRDNARNTLYLQMSSLRSEDTAMYSCAR

EGVYSDYRAWFAYWGQGTLVTVSGGGGSGGGGSGGGGSDIVMSQSPSS

LAVSVGEKVTMSCKSSQSLLYSSNQKNYLAWYQQKPGQSPKLLIYWAST

RESGVPDRFTGSGSGTDFTLTISSVKAEDLAVYYCQQYYSYPRTFGGGT

KLEIKR.

In some embodiments, the anti-CD19 scFv comprises an amino acid sequence:

(SEQ ID NO: 110)
QVKLQESGGGLVKPGGSLKLSCAASGFTFSSYAMSWVRQTPEKRLEWVA

GISSGGSFTYYPDTVKGRFTISRDNARNTLYLQMSSLRSEDTAMYSCAR

EGVYSDYRAWFAYWGQGTLVTVSGGGGSGGGGSGGGGSDIVLTQSTSS

LAVSVGEKVTMSCKSSQSLLFGSNQKNYLAWYQQKLGQSPKLLIFWAST

RESGVPDRFTGSGSGTDFTLTISSVKAEDLAVYYCQQYYSYPFTFGSGT

KLEIKR.

In some embodiments, the anti-CD19 scFv comprises an amino acid sequence:

(SEQ ID NO: 111)
QVKLQESGGGLVKPGGSLKLSCAASGFTFSSYAMSWVRQTPEKRLEWVA

GISSGGSFTYYPDTVKGRFTISRDNARNTLYLQMSSLRSEDTAMYSCAR

EGVYSDYRAWFAYWGQGTLVTVSGGGGSGGGGSGGGGSDIVLTQTNLT

LSITIGQPASISCKSSQSLLDSDGKTYLNWLLQRPGQSPKRLIYLVSKL

DSGVPDRFTGSGSGTDFTLKISRVGAEDLGIYYCWQGTHFPHTFGGGTK

LEIKR.

In some embodiments, the anti-CD19 scFv comprises an amino acid sequence:

(SEQ ID NO: 112)
QVKLQESGGGLVKPGGSLKLSCAASGFTFSSYAMSWVRQTPEKRLEWVA

GISSGGSFTYYPDTVKGRFTISRDNARNTLYLQMSSLRSEDTAMYSCAR

EGVYSDYRAWFAYWGQGTLVTVSGGGGSGGGGSGGGGSDIVLTQSPAI

MSASPGEKVTMTCRASSSVSSSYLHWYQQKSGASPKLWIYSTSNLASGV

PARFSGSGSGTSYSLTISSVEAEDAATYYCQQYSGYPLTFGAGTKLELK

R.

In some embodiments, the anti-CD19 scFv comprises an amino acid sequence:

(SEQ ID NO: 113)
EVKLEQSGPSLVQPSQSLSITCTVSGFSLTNFGVHWVRQSPGKGLEWLG

LIWRGGSTDYNAAFMSRLSITKDNSKSQVFFKMNSLQADDTAIYYCAKM

GITYYFDYWGQGTTLTVSSGGGGSGGGGSGGGGSDIVLTQSHKFMSTSV

GDRVSVTCKASQNVGTNVAWYQQKPGQSPKALIFSASYRNSGVPDRFTG

SGSGTDFTLTITNVQSEDLLEYFCQQYNTYPYTFGGGTKLEIKR.

In some embodiments, the anti-CD19 scFv comprises an amino acid sequence:

(SEQ ID NO: 114)
EVKLEQSGPSLVQPSQSLSITCTVSGFSLTNFGVHWVRQSPGKGLEWLGL

IWRGGSTDYNAAFMSRLSITKDNSKSQVFFKMNSLQADDTAIYYCAKMGI

TYYFDYWGQGTTLTVSSGGGGSGGGGSGGGGSDIVMTQSPASLAVSLGQR

ATISCRASETIDNYGISFMNWFQQKPGQPPKLLIYGASNQGSGVPARFSG

SGSGTDFSLNIHPMEEDDTAMYFCQQNKEFPWTFGGGTKLEIK.

In some embodiments, the anti-CD19 scFv comprises an amino acid sequence:

(SEQ ID NO: 115)
EVKLEQSGPSLVQPSQSLSITCTVSGFSLTNFGVHWVRQSPGKGLEWLGL

IWRGGSTDYNAAFMSRLSITKDNSKSQVFFKMNSLQADDTAIYYCAKMGI

TYYFDYWGQGTTLTVSSGGGGSGGGGSGGGGSDIVMTQSHKFMSTSVGGR

VSVTCKASQNVDTNVAWYQQKPGQSPKALIYSASYRYSGVPDRFTGSGSG

TDFTLTITNVQSEDLAEYFCQQYNSYPLTFGAGTKLELKR.

In some embodiments, the anti-CD19 scFv comprises an amino acid sequence:

(SEQ ID NO: 116)
EVKLEQSGPSLVQPSQSLSITCTVSGFSLTNFGVHWVRQSPGKGLEWLGL

IWRGGSTDYNAAFMSRLSITKDNSKSQVFFKMNSLQADDTAIYYCAKMGI

TYYFDYWGQGTTLTVSSGGGGSGGGGSGGGGSDIVLTQTHKFMSTSVGDR

VSITCKASQDVGTAVAWYQQKPGQSPKLLIYWASTRHTGVPDRFTGSGSG

TDFTLTISNVQSEDLADYFCQQYSSYPLTFGGGTKLEIKR.

In some embodiments, the anti-CD19 scFv comprises an amino acid sequence:

(SEQ ID NO: 117)
EVKLEQSGPSLVQPSQSLSITCTVSGFSLTNFGVHWVRQSPGKGLEWLGL

IWRGGSTDYNAAFMSRLSITKDNSKSQVFFKMNSLQADDTAIYYCAKMGI

TYYFDYWGQGTTLTVSSGGGGSGGGGSGGGGSDIVITQSHKFMPTSVGDR

VSITCKASQDVSTAVAWYQQKPGQSPKLLIYSASYRYTGVPDRFTGSGSG

TDFTFTISSVQAEDLAVYYCQQHYSTPYTFGGGTKLEIKR.

In some embodiments, the anti-CD19 scFv comprises an amino acid sequence:

(SEQ ID NO: 118)
EVKLEQSGPSLVQPSQSLSITCTVSGFSLTNFGVHWVRQSPGKGLEWLGL

IWRGGSTDYNAAFMSRLSITKDNSKSQVFFKMNSLQADDTAIYYCAKMGI

TYYFDYWGQGTTLTVSSGGGGSGGGGSGGGGSDWMTQTPLTLSVTTGQPA

SISCKSSQSLLNSDGKTFLNWLLQRPGQSPKRLIYLVSKLDSGVPDRFTG

SGSGTDFTLKICRVEAEDLGVYYCWQGTHFPYTFGGGTKLEIKR.

In some embodiments, the anti-CD19 scFv comprises an amino acid sequence:

(SEQ ID NO: 119)
EVKLEQSGPSLVQPSQSLSITCTVSGFSLTNFGVHWVRQSPGKGLEWLGL

IWRGGSTDYNAAFMSRLSITKDNSKSQVFFKMNSLQADDTAIYYCAKMGI

TYYFDYWGQGTTLTVSSGGGGSGGGGSGGGGSDIVMSQSPSSLAVSVGEK

VTMSCKSSQSLLYSSNQKNYLAWYQQKPGQSPKLLIYWASTRESGVPDRF

TGSGSGTDFTLTISSVKAEDLAVYYCQQYYSYPRTFGGGTKLEIKR.

In some embodiments, the anti-CD19 scFv comprises an amino acid sequence:

(SEQ ID NO: 120)
EVKLEQSGPSLVQPSQSLSITCTVSGFSLTNFGVHWVRQSPGKGLEWLGL

IWRGGSTDYNAAFMSRLSITKDNSKSQVFFKMNSLQADDTAIYYCAKMGI

TYYFDYWGQGTTLTVSSGGGGSGGGGSGGGGSDIVLTQSTSSLAVSVGEK

VTMSCKSSQSLLFGSNQKNYLAWYQQKLGQSPKLLIFWASTRESGVPDRF

TGSGSGTDFTLTISSVKAEDLAVYYCQQYYSYPFTFGSGTKLEIKR.

In some embodiments, the anti-CD19 scFv comprises an amino acid sequence:

(SEQ ID NO: 121)
EVKLEQSGPSLVQPSQSLSITCTVSGFSLTNFGVHWVRQSPGKGLEWLGL

IWRGGSTDYNAAFMSRLSITKDNSKSQVFFKMNSLQADDTAIYYCAKMGI

TYYFDYWGQGTTLTVSSGGGGSGGGGSGGGGSDIVLTQTNLTLSITIGQP

ASISCKSSQSLLDSDGKTYLNWLLQRPGQSPKRLIYLVSKLDSGVPDRFT

GSGSGTDFTLKISRVGAEDLGIYYCWQGTHFPHTFGGGTKLEIKR.

In some embodiments, the anti-CD19 scFv comprises an amino acid sequence:

(SEQ ID NO: 122)
EVKLEQSGPSLVQPSQSLSITCTVSGFSLTNFGVHWVRQSPGKGLEWLGL

IWRGGSTDYNAAFMSRLSITKDNSKSQVFFKMNSLQADDTAIYYCAKMGI

TYYFDYWGQGTTLTVSSGGGGSGGGGSGGGGSDIVLTQSPAIMSASPGEK

VTMTCRASSSVSSSYLHWYQQKSGASPKLWIYSTSNLASGVPARFSGSGS

GTSYSLTISSVEAEDAATYYCQQYSGYPLTFGAGTKLELKR.

In some embodiments, the anti-CD19 scFv comprises an amino acid sequence:

(SEQ ID NO: 123)
QVKLQQSGDDLVKPGASVKLSCKASGYTFTSYWINWIKQRPGQGLEWIGH

IAPGTGSTYYSEMFKDKATLTVDTPSSSAYIQLSSLSSEDSAVYFCAREG

GRYYTLDCWGQGTSVTVSSGGGGSGGGGSGGGGSDIVLTQSHKFMSTSVG

DRVSVTCKASQNVGTNVAWYQQKPGQSPKALIFSASYRNSGVPDRFTGSG

SGTDFTLTITNVQSEDLLEYFCQQYNTYPYTFGGGTKLEIKR.

In some embodiments, the anti-CD19 scFv comprises an amino acid sequence:

(SEQ ID NO: 124)
QVKLQQSGDDLVKPGASVKLSCKASGYTFTSYWINWIKQRPGQGLEWIGH

IAPGTGSTYYSEMFKDKATLTVDTPSSSAYIQLSSLSSEDSAVYFCAREG

GRYYTLDCWGQGTSVTVSSGGGGSGGGGSGGGGSDIVMTQSPASLAVSLG

QRATISCRASETIDNYGISFMNWFQQKPGQPPKLLIYGASNQGSGVPARF

SGSGSGTDFSLNIHPMEEDDTAMYFCQQNKEFPWTFGGGTKLEIK.

In some embodiments, the anti-CD19 scFv comprises an amino acid sequence:

(SEQ ID NO: 125)
QVKLQQSGDDLVKPGASVKLSCKASGYTFTSYWINWIKQRPGQGLEWIGH

IAPGTGSTYYSEMFKDKATLTVDTPSSSAYIQLSSLSSEDSAVYFCAREG

GRYYTLDCWGQGTSVTVSSGGGGSGGGGSGGGGSDIVMTQSHKFMSTSVGG

RVSVTCKASQNVDTNVAWYQQKPGQSPKALIYSASYRYSGVPDRFTGSGS

GTDFTLTITNVQSEDLAEYFCQQYNSYPLTFGAGTKLELKR.

In some embodiments, the anti-CD19 scFv comprises an amino acid sequence:

(SEQ ID NO: 126)
QVKLQQSGDDLVKPGASVKLSCKASGYTFTSYWINWIKQRPGQGLEWIGH

IAPGTGSTYYSEMFKDKATLTVDTPSSSAYIQLSSLSSEDSAVYFCAREG

GRYYTLDCWGQGTSVTVSSGGGGSGGGGSGGGGSDIVLTQTHKFMSTSVG

DRVSITCKASQDVGTAVAWYQQKPGQSPKLLIYWASTRHTGVPDRFTGSG

SGTDFTLTISNVQSEDLADYFCQQYSSYPLTFGGGTKLEIKR.

In some embodiments, the anti-CD19 scFv comprises an amino acid sequence:

(SEQ ID NO: 127)
QVKLQQSGDDLVKPGASVKLSCKASGYTFTSYWINWIKQRPGQGLEWIGH

IAPGTGSTYYSEMFKDKATLTVDTPSSSAYIQLSSLSSEDSAVYFCAREG

GRYYTLDCWGQGTSVTVSSGGGGSGGGGSGGGGSDIVITQSHKFMPTSVG

DRVSITCKASQDVSTAVAWYQQKPGQSPKLLIYSASYRYTGVPDRFTGSG

SGTDFTFTISSVQAEDLAVYYCQQHYSTPYTFGGGTKLEIKR.

In some embodiments, the anti-CD19 scFv comprises an amino acid sequence:

(SEQ ID NO: 128)
QVKLQQSGDDLVKPGASVKLSCKASGYTFTSYWINWIKQRPGQGLEWIGH
IAPGTGSTYYSEMFKDKATLTVDTPSSSAYIQLSSLSSEDSAVYFCAREG
GRYYTLDCWGQGTSVTVSSGGGGSGGGGSGGGGSDVVMTQTPLTLSVTTG
QPASISCKSSQSLLNSDGKTFLNWLLQRPGQSPKRLIYLVSKLDSGVPDR
FTGSGSGTDFTLKICRVEAEDLGVYYCWQGTHFPYTFGGGTKLEIKR.

In some embodiments, the anti-CD19 scFv comprises an amino acid sequence:

(SEQ ID NO: 129)
QVKLQQSGDDLVKPGASVKLSCKASGYTFTSYWINWIKQRPGQGLEWIG
HIAPGTGSTYYSEMFKDKATLTVDTPSSSAYIQLSSLSSEDSAVYFCAR
EGGRYYTLDCWGQGTSVTVSSGGGGSGGGGSGGGGSDIVMSQSPSSLAV
SVGEKVTMSCKSSQSLLYSSNQKNYLAWYQQKPGQSPKLLIYWASTRES
GVPDRFTGSGSGTDFTLTISSVKAEDLAVYYCQQYYSYPRTFGGGTKLE
IKR.

In some embodiments, the anti-CD19 scFv comprises an amino acid sequence:

(SEQ ID NO: 130)
QVKLQQSGDDLVKPGASVKLSCKASGYTFTSYWINWIKQRPGQGLEWIG
HIAPGTGSTYYSEMFKDKATLTVDTPSSSAYIQLSSLSSEDSAVYFCAR
EGGRYYTLDCWGQGTSVTVSSGGGGSGGGGSGGGGSDIVLTQSTSSLAV
SVGEKVTMSCKSSQSLLFGSNQKNYLAWYQQKLGQSPKLLIFWASTRES
GVPDRFTGSGSGTDFTLTISSVKAEDLAVYYCQQYYSYPFTFGSGTKLE
IKR.

In some embodiments, the anti-CD19 scFv comprises an amino acid sequence:

(SEQ ID NO: 131)
QVKLQQSGDDLVKPGASVKLSCKASGYTFTSYWINWIKQRPGQGLEWIG
HIAPGTGSTYYSEMFKDKATLTVDTPSSSAYIQLSSLSSEDSAVYFCAR
EGGRYYTLDCWGQGTSVTVSSGGGGSGGGGSGGGGSDIVLTQTNLTLSI
TIGQPASISCKSSQSLLDSDGKTYLNWLLQRPGQSPKRLIYLVSKLDSG
VPDRFTGSGSGTDFTLKISRVGAEDLGIYYCWQGTHFPHTFGGGTKLEI
KR.

In some embodiments, the anti-CD19 scFv comprises an amino acid sequence:

(SEQ ID NO: 132)
QVKLQQSGDDLVKPGASVKLSCKASGYTFTSYWINWIKQRPGQGLEWIG
HIAPGTGSTYYSEMFKDKATLTVDTPSSSAYIQLSSLSSEDSAVYFCAR
EGGRYYTLDCWGQGTSVTVSSGGGGSGGGGSGGGGSDIVLTQSPAIMSA
SPGEKVTMTCRASSSVSSSYLHWYQQKSGASPKLWIYSTSNLASGVPAR
FSGSGSGTSYSLTISSVEAEDAATYYCQQYSGYPLTFGAGTKLELKR.

In some embodiments, the anti-CD19 scFv comprises an amino acid sequence:

(SEQ ID NO: 133)
QVQLEESGPGLVKPSQTVSLTCTVTGISITTGNYRWSWIRQFPGNKLEW
IGYIYYSGTITYNPSLTSRTTITRDTSKNQFFLEMNSLTAEDTATYYCA
RWLNNFDVWGTGTTVTVSGGGGSGGGGSGGGGSDIVLTQSHKFMSTSVG
DRVSVTCKASQNVGTNVAWYQQKPGQSPKALIFSASYRNSGVPDRFTGS
GSGTDFTLTITNVQSEDLLEYFCQQYNTYPYTFGGGTKLEIKR.

In some embodiments, the anti-CD19 scFv comprises an amino acid sequence:

(SEQ ID NO: 134)
QVQLEESGPGLVKPSQTVSLTCTVTGISITTGNYRWSWIRQFPGNKLEW
IGYIYYSGTITYNPSLTSRTTITRDTSKNQFFLEMNSLTAEDTATYYCA
RWLNNFDVWGTGTTVTVSGGGGSGGGGSGGGGSDIVMTQSPASLAVSLG
QRATISCRASETIDNYGISFMNWFQQKPGQPPKLLIYGASNQGSGVPAR
FSGSGSGTDFSLNIHPMEEDDTAMYFCQQNKEFPWTFGGGTKLEIK.

In some embodiments, the anti-CD19 scFv comprises an amino acid sequence:

(SEQ ID NO: 135)
QVQLEESGPGLVKPSQTVSLTCTVTGISITTGNYRWSWIRQFPGNKLEW
IGYIYYSGTITYNPSLTSRTTITRDTSKNQFFLEMNSLTAEDTATYYCA
RWLNNFDVWGTGTTVTVSGGGGSGGGGSGGGGSDIVMTQSHKFMSTSVG
GRVSVTCKASQNVDTNVAWYQQKPGQSPKALIYSASYRYSGVPDRFTGS
GSGTDFTLTITNVQSEDLAEYFCQQYNSYPLTFGAGTKLELKR.

In some embodiments, the anti-CD19 scFv comprises an amino acid sequence:

(SEQ ID NO: 136)
QVQLEESGPGLVKPSQTVSLTCTVTGISITTGNYRWSWIRQFPGNKLEW
IGYIYYSGTITYNPSLTSRTTITRDTSKNQFFLEMNSLTAEDTATYYCA
RWLNNFDVWGTGTTVTVSGGGGSGGGGSGGGGSDIVLTQTHKFMSTSVG
DRVSITCKASQDVGTAVAWYQQKPGQSPKLLIYWASTRHTGVPDRFTGS
GSGTDFTLTISNVQSEDLADYFCQQYSSYPLTFGGGTKLEIKR.

In some embodiments, the anti-CD19 scFv comprises an amino acid sequence:

(SEQ ID NO: 137)
QVQLEESGPGLVKPSQTVSLTCTVTGISITTGNYRWSWIRQFPGNKLEW
IGYIYYSGTITYNPSLTSRTTITRDTSKNQFFLEMNSLTAEDTATYYCA
RWLNNFDVWGTGTTVTVSGGGGSGGGGSGGGGSDIVITQSHKFMPTSVG
DRVSITCKASQDVSTAVAWYQQKPGQSPKLLIYSASYRYTGVPDRFTGS
GSGTDFTFTISSVQAEDLAVYYCQQHYSTPYTFGGGTKLEIKR.

In some embodiments, the anti-CD19 scFv comprises an amino acid sequence:

(SEQ ID NO: 138)
QVQLEESGPGLVKPSQTVSLTCTVTGISITTGNYRWSWIRQFPGNKLEW
IGYIYYSGTITYNPSLTSRTTITRDTSKNQFFLEMNSLTAEDTATYYCA
RWLNNFDVWGTGTTVTVSGGGGSGGGGSGGGGSDVVMTQTPLTLSVTTG
QPASISCKSSQSLLNSDGKTFLNWLLQRPGQSPKRLIYLVSKLDSGVPD
RFTGSGSGTDFTLKICRVEAEDLGVYYCWQGTHFPYTFGGGTKLEIKR.

In some embodiments, the anti-CD19 scFv comprises an amino acid sequence:

(SEQ ID NO: 139)
QVQLEESGPGLVKPSQTVSLTCTVTGISITTGNYRWSWIRQFPGNKLEW
IGYIYYSGTITYNPSLTSRTTITRDTSKNQFFLEMNSLTAEDTATYYCA
RWLNNFDVWGTGTTVTVSGGGGSGGGGSGGGGSDIVMSQSPSSLAVSVG
EKVTMSCKSSQSLLYSSNQKNYLAWYQQKPGQSPKLLIYWASTRESGVP
DRFTGSGSGTDFTLTISSVKAEDLAVYYCQQYYSYPRTFGGGTKLEIKR.

In some embodiments, the anti-CD19 scFv comprises an amino acid sequence:

(SEQ ID NO: 140)
QVQLEESGPGLVKPSQTVSLTCTVTGISITTGNYRWSWIRQFPGNKLEW
IGYIYYSGTITYNPSLTSRTTITRDTSKNQFFLEMNSLTAEDTATYYCA
RWLNNFDVWGTGTTVTVSGGGGSGGGGSGGGGSDIVLTQSTSSLAVSVG
EKVTMSCKSSQSLLFGSNQKNYLAWYQQKLGQSPKLLIFWASTRESGVP
DRFTGSGSGTDFTLTISSVKAEDLAVYYCQQYYSYPFTFGSGTKLEIKR.

In some embodiments, the anti-CD19 scFv comprises an amino acid sequence:

(SEQ ID NO: 141)
QVQLEESGPGLVKPSQTVSLTCTVTGISITTGNYRWSWIRQFPGNKLEW
IGYIYYSGTITYNPSLTSRTTITRDTSKNQFFLEMNSLTAEDTATYYCA
RWLNNFDVWGTGTTVTVSGGGGGGGSGGGGSDIVLTQTNLTLSITIGQ
PASISCKSSQSLLDSDGKTYLNWLLQRPGQSPKRLIYLVSKLDSGVPDR
FTGSGSGTDFTLKISRVGAEDLGIYYCWQGTHFPHTFGGGTKLEIKR.

In some embodiments, the anti-CD19 scFv comprises an amino acid sequence:

(SEQ ID NO: 142)
QVQLEESGPGLVKPSQTVSLTCTVTGISITTGNYRWSWIRQFPGNKLEW
IGYIYYSGTITYNPSLTSRTTITRDTSKNQFFLEMNSLTAEDTATYYCA
RWLNNFDVWGTGTTVTVSGGGGSGGGGSGGGGSDIVLTQSPAIMSASPG
EKVTMTCRASSSVSSSYLHWYQQKSGASPKLWIYSTSNLASGVPARFSG
SGSGTSYSLTISSVEAEDAATYYCQQYSGYPLTFGAGTKLELKR.

In some embodiments, the anti-CD19 scFv comprises an amino acid sequence:

(SEQ ID NO: 143)
EVMLVESGGGLVKPGGSLKLSCAASGFTFSRYAMSWNRQTPEKRLEWVA
TISPGGGYIYYSDSVKGRFTISRDNARNTLYLQMSSLRSEDTAMYYCAG
DYVDYWGQGTTLTVSSGGGGSGGGGSGGGGSDIVLTQSHKFMSTSVGDR
VSVTCKASQNVGTNVAWYQQKPGQSPKALIFSASYRNSGVPDRFTGSGS
GTDFTLTITNVQSEDLLEYFCQQYNTYPYTFGGGTKLEIKR.

In some embodiments, the anti-CD19 scFv comprises an amino acid sequence:

(SEQ ID NO: 144)
EVMLVESGGGLVKPGGSLKLSCAASGFTFSRYAMSWNRQTPEKRLEWVA
TISPGGGYIYYSDSVKGRFTISRDNARNTLYLQMSSLRSEDTAMYYCAG
DYVDYWGQGTTLTVSSGGGGSGGGGSGGGGSDIVMTQSPASLAVSLGQR
ATISCRASETIDNYGISFMNWFQQKPGQPPKLLIYGASNQGSGVPARFS
GSGSGTDFSLNIHPMEEDDTAMYFCQQNKEFPWTFGGGTKLEIKR.

In some embodiments, the anti-CD19 scFv comprises an amino acid sequence:

(SEQ ID NO: 145)
EVMLVESGGGLVKPGGSLKLSCAASGFTFSRYAMSWNRQTPEKRLEWVA
TISPGGGYIYYSDSVKGRFTISRDNARNTLYLQMSSLRSEDTAMYYCAG
DYVDYWGQGTTLTVSSGGGGSGGGGSGGGGSDIVMTQSHKFMSTSVGGR
VSVTCKASQNVDTNVAWYQQKPGQSPKALIYSASYRYSGVPDRFTGSGS
GTDFTLTITNVQSEDLAEYFCQQYNSYPLTFGAGTKLELKR.

In some embodiments, the anti-CD19 scFv comprises an amino acid sequence:

(SEQ ID NO: 146)
EVMLVESGGGLVKPGGSLKLSCAASGFTFSRYAMSWNRQTPEKRLEWVA
TISPGGGYIYYSDSVKGRFTISRDNARNTLYLQMSSLRSEDTAMYYCAG
DYVDYWGQGTTLTVSSGGGGSGGGGSGGGGSDIVLTQTHKFMSTSVGDR
VSITCKASQDVGTAVAWYQQKPGQSPKLLIYWASTRHTGVPDRFTGSGS
GTDFTLTISNVQSEDLADYFCQQYSSYPLTFGGGTKLEIKR.

In some embodiments, the anti-CD19 scFv comprises an amino acid sequence:

(SEQ ID NO: 147)
EVMLVESGGGLVKPGGSLKLSCAASGFTFSRYAMSWNRQTPEKRLEWVA
TISPGGGYIYYSDSVKGRFTISRDNARNTLYLQMSSLRSEDTAMYYCAG
DYVDYWGQGTTLTVSSGGGGSGGGGSGGGGSDIVITQSHKFMPTSVGDR
VSITCKASQDVSTAVAWYQQKPGQSPKLLIYSASYRYTGVPDRFTGSGS
GTDFTFTISSVQAEDLAVYYCQQHYSTPYTFGGGTKLEIKR.

In some embodiments, the anti-CD19 scFv comprises an amino acid sequence:

(SEQ ID NO: 148)
EVMLVESGGGLVKPGGSLKLSCAASGFTFSRYAMSWNRQTPEKRLEWVA
TISPGGGYIYYSDSVKGRFTISRDNARNTLYLQMSSLRSEDTAMYYCAG
DYVDYWGQGTTLTVSSGGGGSGGGGSGGGGSDVVMTQTPLTLSVTTGQP
ASISCKSSQSLLNSDGKTFLNWLLQRPGQSPKRLIYLVSKLDSGVPDRF
TGSGSGTDFTLKICRVEAEDLGVYYCWQGTHFPYTFGGGTKLEIKR.

In some embodiments, the anti-CD19 scFv comprises an amino acid sequence:

(SEQ ID NO: 149)
EVMLVESGGGLVKPGGSLKLSCAASGFTFSRYAMSWNRQTPEKRLEWVA
TISPGGGYIYYSDSVKGRFTISRDNARNTLYLQMSSLRSEDTAMYYCAG
DYVDYWGQGTTLTVSSGGGGSGGGGSGGGGSDIVMSQSPSSLAVSVGEK
VTMSCKSSQSLLYSSNQKNYLAWYQQKPGQSPKLLIYWASTRESGVPDR
FTGSGSGTDFTLTISSVKAEDLAVYYCQQYYSYPRTFGGGTKLEIKR.

In some embodiments, the anti-CD19 scFv comprises an amino acid sequence:

(SEQ ID NO: 150)
EVMLVESGGGLVKPGGSLKLSCAASGFTFSRYAMSWNRQTPEKRLEWVA
TISPGGGYIYYSDSVKGRFTISRDNARNTLYLQMSSLRSEDTAMYYCAG
DYVDYWGQGTTLTVSSGGGGGGGGSGGGGSDIVLTQSTSSLAVSVGEKV
TMSCKSSQSLLFGSNQKNYLAWYQQKLGQSPKLLIFWASTRESGVPDRF
TGSGSGTDFTLTISSVKAEDLAVYYCQQYYSYPFTFGSGTKLEIKR.

In some embodiments, the anti-CD19 scFv comprises an amino acid sequence:

(SEQ ID NO: 151)
EVMLVESGGGLVKPGGSLKLSCAASGFTFSRYAMSWNRQTPEKRLEWVA
TISPGGGYIYYSDSVKGRFTISRDNARNTLYLQMSSLRSEDTAMYYCAG
DYVDYWGQGTTLTVSSGGGGSGGGGSGGGGSDIVLTQTNLTLSITIGQP
ASISCKSSQSLLDSDGKTYLNWLLQRPGQSPKRLIYLVSKLDSGVPDRF
TGSGSGTDFTLKISRVGAEDLGIYYCWQGTHFPHTFGGGTKLEIKR.

In some embodiments, the anti-CD19 scFv comprises an amino acid sequence:

(SEQ ID NO: 152)
EVMLVESGGGLVKPGGSLKLSCAASGFTFSRYAMSWNRQTPEKRLEWVA
TISPGGGYIYYSDSVKGRFTISRDNARNTLYLQMSSLRSEDTAMYYCAG
DYVDYWGQGTTLTVSSGGGGSGGGGSGGGGSDIVLTQSPAIMSASPGEK
VTMTCRASSSVSSSYLHWYQQKSGASPKLWIYSTSNLASGVPARFSGSG
SGTSYSLTISSVEAEDAATYYCQQYSGYPLTFGAGTKLELKR.

In some embodiments, the anti-CD19 scFv comprises an amino acid sequence:

(SEQ ID NO: 153)
QVQLQESGPGLVKPSQSLSLTCTVTGYSITSDYAWNWIRQFPGNKLEWM
GYISYSGSTTYNPSLKGRISFTRDTSKNQFFLHLKSVTTEDSATYYCAR
NWVYAMDYWGQGTSVTVSSGGGGSGGGGSGGGGSDIVLTQSHKFMSTSV
GDRVSVTCKASQNVGTNVAWYQQKPGQSPKALIFSASYRNSGVPDRFTG
SGSGTDFTLTITNVQSEDLLEYFCQQYNTYPYTFGGGTKLEIKR.

In some embodiments, the anti-CD19 scFv comprises an amino acid sequence:

(SEQ ID NO: 154)
QVQLQESGPGLVKPSQSLSLTCTVTGYSITSDYAWNWIRQFPGNKLEWM
GYISYSGSTTYNPSLKGRISFTRDTSKNQFFLHLKSVTTEDSATYYCAR
NWVYAMDYWGQGTSVTVSSGGGGSGGGGSGGGGSDIVMTQSPASLAVSL
GQRATISCRASETIDNYGISFMNWFQQKPGQPPKLLIYGASNQGSGVPA
RFSGSGSGTDFSLNIHPMEEDDTAMYFCQQNKEFPWTFGGGTKLEIKR.

In some embodiments, the anti-CD19 scFv comprises an amino acid sequence:

(SEQ ID NO: 155)
QVQLQESGPGLVKPSQSLSLTCTVTGYSITSDYAWNWIRQFPGNKLEWM
GYISYSGSTTYNPSLKGRISFTRDTSKNQFFLHLKSVTTEDSATYYCAR
NWVYAMDYWGQGTSVTVSSGGGGSGGGGSGGGGSDIVMTQSHKFMSTSV
GGRVSVTCKASQNVDTNVAWYQQKPGQSPKALIYSASYRYSGVPDRFTG
SGSGTDFTLTITNVQSEDLAEYFCQQYNSYPLTFGAGTKLELKR.

In some embodiments, the anti-CD19 scFv comprises an amino acid sequence:

(SEQ ID NO: 156)
QVQLQESGPGLVKPSQSLSLTCTVTGYSITSDYAWNWIRQFPGNKLEWM
GYISYSGSTTYNPSLKGRISFTRDTSKNQFFLHLKSVTTEDSATYYCAR
NWVYAMDYWGQGTSVTVSSGGGGSGGGGSGGGGSDIVLTQSHKFMSTSV
GDRVSVTCKASQNVGTNVAWYQQKPGQSPKALIFSASYRNSGVPDRFTG
SGSGTDFTLTITNVQSEDLLEYFCQQYNTYPYTFGGGTKLEIKR.

In some embodiments, the anti-CD19 scFv comprises an amino acid sequence:

(SEQ ID NO: 157)
QVQLQESGPGLVKPSQSLSLTCTVTGYSITSDYAWNWIRQFPGNKLEWM
GYISYSGSTTYNPSLKGRISFTRDTSKNQFFLHLKSVTTEDSATYYCAR
NWVYAMDYWGQGTSVTVSSGGGGSGGGGSGGGGSDIVITQSHKFMPTSV
GDRVSITCKASQDVSTAVAWYQQKPGQSPKLLIYSASYRYTGVPDRFTG
SGSGTDFTFTISSVQAEDLAVYYCQQHYSTPYTFGGGTKLEIKR.

In some embodiments, the anti-CD19 scFv comprises an amino acid sequence:

In some embodiments, the anti-CD19 scFv comprises an amino acid sequence:

(SEQ ID NO: 158)
QVQLQESGPGLVKPSQSLSLTCTVTGYSITSDYAWNWIRQFPGNKLEWM
GYISYSGSTTYNPSLKGRISFTRDTSKNQFFLHLKSVTTEDSATYYCAR
NWVYAMDYWGQGTSVTVSSGGGGSGGGGSGGGGSDVVMTQTPLTLSVTT
GQPASISCKSSQSLLNSDGKTFLNWLLQRPGQSPKRLIYLVSKLDSGVP
DRFTGSGSGTDFTLKICRVEAEDLGVYYCWQGTHFPYTFGGGTKLEIKR.

In some embodiments, the anti-CD19 scFv comprises an amino acid sequence:

(SEQ ID NO: 159)
QVQLQESGPGLVKPSQSLSLTCTVTGYSITSDYAWNWIRQFPGNKLEWMG
YISYSGSTTYNPSLKGRISFTRDTSKNQFFLHLKSVTTEDSATYYCARNW
VYAMDYWGQGTSVTVSSGGGGSGGGGSGGGGSDIVMSQSPSSLAVSVGEK
VTMSCKSSQSLLYSSNQKNYLAWYQQKPGQSPKLLIYWASTRESGVPDRF
TGSGSGTDFTLTISSVKAEDLAVYYCQQYYSYPRTFGGGTKLEIKR.

In some embodiments, the anti-CD19 scFv comprises an amino acid sequence:

(SEQ ID NO: 160)
QVQLQESGPGLVKPSQSLSLTCTVTGYSITSDYAWNWIRQFPGNKLEWMG
YISYSGSTTYNPSLKGRISFTRDTSKNQFFLHLKSVTTEDSATYYCARNW
VYAMDYWGQGTSVTVSSGGGGSGGGGSGGGGSDIVLTQSTSSLAVSVGEK
VTMSCKSSQSLLFGSNQKNYLAWYQQKLGQSPKLLIFWASTRESGVPDRF
TGSGSGTDFTLTISSVKAEDLAVYYCQQYYSYPFTFGSGTKLEIKR.

In some embodiments, the anti-CD19 scFv comprises an amino acid sequence:

(SEQ ID NO: 161)
QVQLQESGPGLVKPSQSLSLTCTVTGYSITSDYAWNWIRQFPGNKLEWMG
YISYSGSTTYNPSLKGRISFTRDTSKNQFFLHLKSVTTEDSATYYCARNW
VYAMDYWGQGTSVTVSSGGGGSGGGGSGGGGSDIVLTQTNLTLSITIGQP
ASISCKSSQSLLDSDGKTYLNWLLQRPGQSPKRLIYLVSKLDSGVPDRFT
GSGSGTDFTLKISRVGAEDLGIYYCWQGTHFPHTFGGGTKLEIKR.

In some embodiments, the anti-CD19 scFv comprises an amino acid sequence:

(SEQ ID NO: 162)
QVQLQESGPGLVKPSQSLSLTCTVTGYSITSDYAWNWIRQFPGNKLEWMG
YISYSGSTTYNPSLKGRISFTRDTSKNQFFLHLKSVTTEDSATYYCARNW
VYAMDYWGQGTSVTVSSGGGGSGGGGSGGGGSDIVLTQSPAIMSASPGEK
VTMTCRASSSVSSSYLHWYQQKSGASPKLWIYSTSNLASGVPARFSGSGS
GTSYSLTISSVEAEDAATYYCQQYSGYPLTFGAGTKLELKR.

In some embodiments, the anti-CD19 scFv comprises an amino acid sequence:

(SEQ ID NO: 163)
EVKLQQSGPVLVKPGASVKISCKASGYTFTDYYYMNWVKQSHGKSLEWIG
YIYPNNSGTSYNQKFRGKATLTVDKSSSTAYMEVRSLTSEDSAVYYCARY
YDGFNAGFAYWGQGTLVTVSAGGGGSGGGGSGGGGSDIVLTQSHKFMSTS
VGDRVSVTCKASQNVGTNVAWYQQKPGQSPKALIFSASYRNSGVPDRFTG
SGSGTDFTLTITNVQSEDLLEYFCQQYNTYPYTFGGGTKLEIKR.

In some embodiments, the anti-CD19 scFv comprises an amino acid sequence:

(SEQ ID NO: 164)
EVKLQQSGPVLVKPGASVKISCKASGYTFTDYYYMNWVKQSHGKSLEWIG
YIYPNNSGTSYNQKFRGKATLTVDKSSSTAYMEVRSLTSEDSAVYYCARY
YDGFNAGFAYWGQGTLVTVSAGGGGSGGGGSGGGGSDIVMTQSPASLAVS
LGQRATISCRASETIDNYGISFMNWFQQKPGQPPKLLIYGASNQGSGVPA
RFSGSGSGTDFSLNIHPMEEDDTAMYFCQQNKEFPWTFGGGTKLEIKR.

In some embodiments, the anti-CD19 scFv comprises an amino acid sequence:

(SEQ ID NO: 165)
EVKLQQSGPVLVKPGASVKISCKASGYTFTDYYYMNWVKQSHGKSLEWIG
YIYPNNSGTSYNQKFRGKATLTVDKSSSTAYMEVRSLTSEDSAVYYCARY
YDGFNAGFAYWGQGTLVTVSAGGGGSGGGGSGGGGSDIVMTQSHKFMSTS
VGGRVSVTCKASQNVDTNVAWYQQKPGQSPKALIYSASYRYSGVPDRFTG
SGSGTDFTLTITNVQSEDLAEYFCQQYNSYPLTFGAGTKLELKR.

In some embodiments, the anti-CD19 scFv comprises an amino acid sequence:

(SEQ ID NO: 166)
EVKLQQSGPVLVKPGASVKISCKASGYTFTDYYYMNWVKQSHGKSLEWIG
YIYPNNSGTSYNQKFRGKATLTVDKSSSTAYMEVRSLTSEDSAVYYCARY
YDGFNAGFAYWGQGTLVTVSAGGGGSGGGGSGGGGSDIVLTQSHKFMSTS
VGDRVSVTCKASQNVGTNVAWYQQKPGQSPKALIFSASYRNSGVPDRFTG
SGSGTDFTLTITNVQSEDLLEYFCQQYNTYPYTFGGGTKLEIKR.

In some embodiments, the anti-CD19 scFv comprises an amino acid sequence:

(SEQ ID NO: 167)
EVKLQQSGPVLVKPGASVKISCKASGYTFTDYYYMNWVKQSHGKSLEWIG
YIYPNNSGTSYNQKFRGKATLTVDKSSSTAYMEVRSLTSEDSAVYYCARY
YDGFNAGFAYWGQGTLVTVSAGGGGSGGGGSGGGGSDIVITQSHKFMPTS
VGDRVSITCKASQDVSTAVAWYQQKPGQSPKLLIYSASYRYTGVPDRFTG
SGSGTDFTFTISSVQAEDLAVYYCQQHYSTPYTFGGGTKLEIKR.

In some embodiments, the anti-CD19 scFv comprises an amino acid sequence:

(SEQ ID NO: 168)
EVKLQQSGPVLVKPGASVKISCKASGYTFTDYYYMNWVKQSHGKSLEWIG
YIYPNNSGTSYNQKFRGKATLTVDKSSSTAYMEVRSLTSEDSAVYYCARY
YDGFNAGFAYWGQGTLVTVSAGGGGSGGGGSGGGGSDVVMTQTPLTLSVT
TGQPASISCKSSQSLLNSDGKTFLNWLLQRPGQSPKRLIYLVSKLDSGVP
DRFTGSGSGTDFTLKICRVEAEDLGVYYCWQGTHFPYTFGGGTKLEIKR.

In some embodiments, the anti-CD19 scFv comprises an amino acid sequence:

(SEQ ID NO: 169)
EVKLQQSGPVLVKPGASVKISCKASGYTFTDYYYMNWVKQSHGKSLEWI
GYIYPNNSGTSYNQKFRGKATLTVDKSSSTAYMEVRSLTSEDSAVYYCA
RYYDGFNAGFAYWGQGTLVTVSAGGGGSGGGGSGGGGSDIVMSQSPSSL
AVSVGEKVTMSCKSSQSLLYSSNQKNYLAWYQQKPGQSPKLLIYWASTR
ESGVPDRFTGSGSGTDFTLTISSVKAEDLAVYYCQQYYSYPRTFGGGTK
LEIKR.

In some embodiments, the anti-CD19 scFv comprises an amino acid sequence:

(SEQ ID NO: 170)
EVKLQQSGPVLVKPGASVKISCKASGYTFTDYYYMNWVKQSHGKSLEWI
GYIYPNNSGTSYNQKFRGKATLTVDKSSSTAYMEVRSLTSEDSAVYYCA
RYYDGFNAGFAYWGQGTLVTVSAGGGGSGGGGSGGGGSDIVLTQSTSSL
AVSVGEKVTMSCKSSQSLLFGSNQKNYLAWYQQKLGQSPKLLIFWASTR
ESGVPDRFTGSGSGTDFTLTISSVKAEDLAVYYCQQYYSYPFTFGSGTK
LEIKR.

In some embodiments, the anti-CD19 scFv comprises an amino acid sequence:

(SEQ ID NO: 171)
EVKLQQSGPVLVKPGASVKISCKASGYTFTDYYYMNWVKQSHGKSLEWIG
YIYPNNSGTSYNQKFRGKATLTVDKSSSTAYMEVRSLTSEDSAVYYCARY
YDGFNAGFAYWGQGTLVTVSAGGGGSGGGGSGGGGSDIVLTQTNLTLSIT
IGQPASISCKSSQSLLDSDGKTYLNWLLQRPGQSPKRLIYLVSKLDSGVP
DRFTGSGSGTDFTLKISRVGAEDLGIYYCWQGTHFPHTFGGGTKLEIKR.

In some embodiments, the anti-CD19 scFv comprises an amino acid sequence:

(SEQ ID NO: 172)
EVKLQQSGPVLVKPGASVKISCKASGYTFTDYYYMNWVKQSHGKSLEWIG
YIYPNNSGTSYNQKFRGKATLTVDKSSSTAYMEVRSLTSEDSAVYYCARY
YDGFNAGFAYWGQGTLVTVSAGGGGSGGGGSGGGGSDIVLTQSPAIMSAS
PGEKVTMTCRASSSVSSSYLHWYQQKSGASPKLWIYSTSNLASGVPARFS
GSGSGTSYSLTISSVEAEDAATYYCQQYSGYPLTFGAGTKLELKR.

In some embodiments, the anti-CD19 scFv comprises an amino acid sequence:

(SEQ ID NO: 173)
QVQLEESGPGLVAPSQSLSITCTVSGFSLSRYSVHWVRQPPGKGLEWLGM
IWVNGNTDYNSALKSRLNINKDNSKSQVFLKMNSLQTDDTAMYYCATYYG
NYDSFTYWGQGTLVTVSAGGGGSGGGGSGGGGSDIVLTQSHKFMSTSVGD
RVSVTCKASQNVGTNVAWYQQKPGQSPKALIFSASYRNSGVPDRFTGSGS
GTDFTLTITNVQSEDLLEYFCQQYNTYPYTFGGGTKLEIKR.

In some embodiments, the anti-CD19 scFv comprises an amino acid sequence:

(SEQ ID NO: 174)
QVQLEESGPGLVAPSQSLSITCTVSGFSLSRYSVHWVRQPPGKGLEWLG
MIWVNGNTDYNSALKSRLNINKDNSKSQVFLKMNSLQTDDTAMYYCATY
YGNYDSFTYWGQGTLVTVSAGGGGSGGGGSGGGGSDIVMTQSPASLAVS
LGQRATISCRASETIDNYGISFMNWFQQKPGQPPKLLIYGASNQGSGVP
ARFSGSGSGTDFSLNIHPMEEDDTAMYFCQQNKEFPWTFGGGTKLEIKR.

In some embodiments, the anti-CD19 scFv comprises an amino acid sequence:

(SEQ ID NO: 175)
QVQLEESGPGLVAPSQSLSITCTVSGFSLSRYSVHWVRQPPGKGLEWLG
MIWVNGNTDYNSALKSRLNINKDNSKSQVFLKMNSLQTDDTAMYYCATY
YGNYDSFTYWGQGTLVTVSAGGGGSGGGGSGGGGSDIVMTQSHKFMSTS
VGGRVSVTCKASQNVDTNVAWYQQKPGQSPKALIYSASYRYSGVPDRFT
GSGSGTDFTLTITNVQSEDLAEYFCQQYNSYPLTFGAGTKLELKR.

In some embodiments, the anti-CD19 scFv comprises an amino acid sequence:

(SEQ ID NO: 176)
QVQLEESGPGLVAPSQSLSITCTVSGFSLSRYSVHWVRQPPGKGLEWLG
MIWVNGNTDYNSALKSRLNINKDNSKSQVFLKMNSLQTDDTAMYYCATY
YGNYDSFTYWGQGTLVTVSAGGGGSGGGGSGGGGSDIVLTQSHKFMSTS
VGDRVSVTCKASQNVGTNVAWYQQKPGQSPKALIFSASYRNSGVPDRFT
GSGSGTDFTLTITNVQSEDLLEYFCQQYNTYPYTFGGGTKLEIKR.

In some embodiments, the anti-CD19 scFv comprises an amino acid sequence:

(SEQ ID NO: 177)
QVQLEESGPGLVAPSQSLSITCTVSGFSLSRYSVHWVRQPPGKGLEWLG
MIWVNGNTDYNSALKSRLNINKDNSKSQVFLKMNSLQTDDTAMYYCATY
YGNYDSFTYWGQGTLVTVSAGGGGSGGGGSGGGGSDIVITQSHKFMPTS
VGDRVSITCKASQDVSTAVAWYQQKPGQSPKLLIYSASYRYTGVPDRFT
GSGSGTDFTFTISSVQAEDLAVYYCQQHYSTPYTFGGGTKLEIKR.

In some embodiments, the anti-CD19 scFv comprises an amino acid sequence:

(SEQ ID NO: 178)
QVQLEESGPGLVAPSQSLSITCTVSGFSLSRYSVHWVRQPPGKGLEWLG
MIWVNGNTDYNSALKSRLNINKDNSKSQVFLKMNSLQTDDTAMYYCATY
YGNYDSFTYWGQGTLVTVSAGGGGSGGGGSGGGGSDVVMTQTPLTLSVT
TGQPASISCKSSQSLLNSDGKTFLNWLLQRPGQSPKRLIYLVSKLDSGV
PDRFTGSGSGTDFTLKICRVEAEDLGVYYCWQGTHFPYTFGGGTKLEIK
R.

In some embodiments, the anti-CD19 scFv comprises an amino acid sequence:

(SEQ ID NO: 179)
QVQLEESGPGLVAPSQSLSITCTVSGFSLSRYSVHWVRQPPGKGLEWLG
MIWVNGNTDYNSALKSRLNINKDNSKSQVFLKMNSLQTDDTAMYYCATY
YGNYDSFTYWGQGTLVTVSAGGGGSGGGGSGGGGSDIVMSQSPSSLAVS
VGEKVTMSCKSSQSLLYSSNQKNYLAWYQQKPGQSPKLLIYWASTRESG
VPDRFTGSGSGTDFTLTISSVKAEDLAVYYCQQYYSYPRTFGGGTKLEI
KR.

In some embodiments, the anti-CD19 scFv comprises an amino acid sequence:

(SEQ ID NO: 180)
QVQLEESGPGLVAPSQSLSITCTVSGFSLSRYSVHWVRQPPGKGLEWLG
MIWVNGNTDYNSALKSRLNINKDNSKSQVFLKMNSLQTDDTAMYYCATY
YGNYDSFTYWGQGTLVTVSAGGGGSGGGGSGGGGSDIVLTQSTSSLAVS
VGEKVTMSCKSSQSLLFGSNQKNYLAWYQQKLGQSPKLLIFWASTRESG
VPDRFTGSGSGTDFTLTISSVKAEDLAVYYCQQYYSYPFTFGSGTKLEI
KR.

In some embodiments, the anti-CD19 scFv comprises an amino acid sequence:

(SEQ ID NO: 181)
QVQLEESGPGLVAPSQSLSITCTVSGFSLSRYSVHWVRQPPGKGLEWLG
MIWVNGNTDYNSALKSRLNINKDNSKSQVFLKMNSLQTDDTAMYYCATY
YGNYDSFTYWGQGTLVTVSAGGGGSGGGGSGGGGSDIVLTQTNLTLSIT
IGQPASISCKSSQSLLDSDGKTYLNWLLQRPGQSPKRLIYLVSKLDSGV
PDRFTGSGSGTDFTLKISRVGAEDLGIYYCWQGTHFPHTFGGGTKLEIK
R.

In some embodiments, the anti-CD19 scFv comprises an amino acid sequence:

(SEQ ID NO: 182)
QVQLEESGPGLVAPSQSLSITCTVSGFSLSRYSVHWVRQPPGKGLEWLG
MIWVNGNTDYNSALKSRLNINKDNSKSQVFLKMNSLQTDDTAMYYCATY
YGNYDSFTYWGQGTLVTVSAGGGGSGGGGSGGGGSDIVLTQSPAIMSAS
PGEKVTMTCRASSSVSSSYLHWYQQKSGASPKLWIYSTSNLASGVPARF
SGSGSGTSYSLTISSVEAEDAATYYCQQYSGYPLTFGAGTKLELKR.

In some embodiments, the anti-CD19 scFv comprises an amino acid sequence:

(SEQ ID NO: 183)
EVQLQESGAELARPGASVKMSCKASGYTFTSYWMHWVKQRPGQGLEWIG
AIYPGNSDTSYNQKFKGKAKLTAVTSASTAYMELSSLTNEDSAVYYCTT
SLAYWGQGTLVTVSAGGGGSGGGGSGGGGSDIVLTQSHKFMSTSVGDRV
SVTCKASQNVGTNVAWYQQKPGQSPKALIFSASYRNSGVPDRFTGSGSG
TDFTLTITNVQSEDLLEYFCQQYNTYPYTFGGGTKLEIKR.

In some embodiments, the anti-CD19 scFv comprises an amino acid sequence:

(SEQ ID NO: 184)
EVQLQESGAELARPGASVKMSCKASGYTFTSYWMHWVKQRPGQGLEWIG
AIYPGNSDTSYNQKFKGKAKLTAVTSASTAYMELSSLTNEDSAVYYCTT
SLAYWGQGTLVTVSAGGGGSGGGGSGGGGSDIVMTQSPASLAVSLGQRA
TISCRASETIDNYGISFMNWFQQKPGQPPKLLIYGASNQGSGVPARFSG
SGSGTDFSLNIHPMEEDDTAMYFCQQNKEFPWTFGGGTKLEIKR.

In some embodiments, the anti-CD19 scFv comprises an amino acid sequence:

(SEQ ID NO: 185)
EVQLQESGAELARPGASVKMSCKASGYTFTSYWMHWVKQRPGQGLEWIG
AIYPGNSDTSYNQKFKGKAKLTAVTSASTAYMELSSLTNEDSAVYYCTT
SLAYWGQGTLVTVSAGGGGSGGGGSGGGGSDIVMTQSHKFMSTSVGGRV
SVTCKASQNVDTNVAWYQQKPGQSPKALIYSASYRYSGVPDRFTGSGSG
TDFTLTITNVQSEDLAEYFCQQYNSYPLTFGAGTKLELKR.

In some embodiments, the anti-CD19 scFv comprises an amino acid sequence:

(SEQ ID NO: 186)
EVQLQESGAELARPGASVKMSCKASGYTFTSYWMHWVKQRPGQGLEWIG
AIYPGNSDTSYNQKFKGKAKLTAVTSASTAYMELSSLTNEDSAVYYCTT
SLAYWGQGTLVTVSAGGGGSGGGGSGGGGSDIVLTQSHKFMSTSVGDRV
SVTCKASQNVGTNVAWYQQKPGQSPKALIFSASYRNSGVPDRFTGSGSG
TDFTLTITNVQSEDLLEYFCQQYNTYPYTFGGGTKLEIKR.

In some embodiments, the anti-CD19 scFv comprises an amino acid sequence:

(SEQ ID NO: 187)
EVQLQESGAELARPGASVKMSCKASGYTFTSYWMHWVKQRPGQGLEWIG
AIYPGNSDTSYNQKFKGKAKLTAVTSASTAYMELSSLTNEDSAVYYCTT
SLAYWGQGTLVTVSAGGGGSGGGGSGGGGSDIVITQSHKFMPTSVGDRV

SITCKASQDVSTAVAWYQQKPGQSPKLLIYSASYRYTGVPDRFTGSGSG

TDFTFTISSVQAEDLAVYYCQQHYSTPYTFGGGTKLEIKR.

In some embodiments, the anti-CD19 scFv comprises an amino acid sequence:

(SEQ ID NO: 188)
EVQLQESGAELARPGASVKMSCKASGYTFTSYWMHWVKQRPGQGLEWIG

AIYPGNSDTSYNQKFKGKAKLTAVTSASTAYMELSSLTNEDSAVYYCTT

SLAYWGQGTLVTVSAGGGGSGGGGSGGGGSDVVMTQTPLTLSVTTGQPA

SISCKSSQSLLNSDGKTFLNWLLQRPGQSPKRLIYLVSKLDSGVPDRFT

GSGSGTDFTLKICRVEAEDLGVYYCWQGTHFPYTFGGGTKLEIKR.

In some embodiments, the anti-CD19 scFv comprises an amino acid sequence:

(SEQ ID NO: 189)
EVQLQESGAELARPGASVKMSCKASGYTFTSYWMHWVKQRPGQGLEWIG

AIYPGNSDTSYNQKFKGKAKLTAVTSASTAYMELSSLTNEDSAVYYCTT

SLAYWGQGTLVTVSAGGGGSGGGGSGGGGSDIVMSQSPSSLAVSVGEKV

TMSCKSSQSLLYSSNQKNYLAWYQQKPGQSPKLLIYWASTRESGVPDRF

TGSGSGTDFTLTISSVKAEDLAVYYCQQYYSYPRTFGGGTKLEIKR.

In some embodiments, the anti-CD19 scFv comprises an amino acid sequence:

(SEQ ID NO: 190)
EVQLQESGAELARPGASVKMSCKASGYTFTSYWMHWVKQRPGQGLEWIG

AIYPGNSDTSYNQKFKGKAKLTAVTSASTAYMELSSLTNEDSAVYYCTT

SLAYWGQGTLVTVSAGGGGSGGGGSGGGGSDIVLTQSTSSLAVSVGEKV

TMSCKSSQSLLFGSNQKNYLAWYQQKLGQSPKLLIFWASTRESGVPDRF

TGSGSGTDFTLTISSVKAEDLAVYYCQQYYSYPFTFGSGTKLEIKR.

In some embodiments, the anti-CD19 scFv comprises an amino acid sequence:

(SEQ ID NO: 191)
EVQLQESGAELARPGASVKMSCKASGYTFTSYWMHWVKQRPGQGLEWIG

AIYPGNSDTSYNQKFKGKAKLTAVTSASTAYMELSSLTNEDSAVYYCTT

SLAYWGQGTLVTVSAGGGGGGGGSGGGGSDIVLTQTNLTLSITIGQPAS

ISCKSSQSLLDSDGKTYLNWLLQRPGQSPKRLIYLVSKLDSGVPDRFTG

SGSGTDFTLKISRVGAEDLGIYYCWQGTHFPHTFGGGTKLEIKR.

In some embodiments, the anti-CD19 scFv comprises an amino acid sequence:

(SEQ ID NO: 192)
EVQLQESGAELARPGASVKMSCKASGYTFTSYWMHWVKQRPGQGLEWIG

AIYPGNSDTSYNQKFKGKAKLTAVTSASTAYMELSSLTNEDSAVYYCTT

SLAYWGQGTLVTVSAGGGGSGGGGSGGGGSDIVLTQSPAIMSASPGEKV

TMTCRASSSVSSSYLHWYQQKSGASPKLWIYSTSNLASGVPARFSGSGS

GTSYSLTISSVEAEDAATYYCQQYSGYPLTFGAGTKLELKR.

In some embodiments, the anti-CD19 scFv comprises an amino acid sequence:

(SEQ ID NO: 193)
DIVLTQSHKFMSTSVGDRVSVTCKASQNVGTNVAWYQQKPGQSPKALIF

SASYRNSGVPDRFTGSGSGTDFTLTITNVQSEDLLEYFCQQYNTYPYTF

GGGTKLEIKRGGGGSGGGGSGGGGSEVKLEESGGGLVKPGGSLKLSCAA

SGFTFSSYAMSWVRQTPEKRLEWVASISSGGSTYYPDSVKGRFTISRDN

ARNTLYLQMSSLRSEDTAMYYCARGRDGYSLYFDYWGQGTTLTVSS.

In some embodiments, the anti-CD19 scFv comprises an amino acid sequence:

(SEQ ID NO: 194)
DIVLTQSHKFMSTSVGDRVSVTCKASQNVGTNVAWYQQKPGQSPKALIF

SASYRNSGVPDRFTGSGSGTDFTLTITNVQSEDLLEYFCQQYNTYPYTF

GGGTKLEIKRGGGGSGGGGSGGGGSQVKLQESGGGLVKPGGSLKLSCAA

SGFTFSSYAMSWVRQTPEKRLEWVAGISSGGSFTYYPDTVKGRFTISRD

NARNTLYLQMSSLRSEDTAMYSCAREGVYSDYRAWFAYWGQGTLVT.

In some embodiments, the anti-CD19 scFv comprises an amino acid sequence:

(SEQ ID NO: 195)
DIVLTQSHKFMSTSVGDRVSVTCKASQNVGTNVAWYQQKPGQSPKALIF

SASYRNSGVPDRFTGSGSGTDFTLTITNVQSEDLLEYFCQQYNTYPYTF

GGGTKLEIKRGGGGSGGGGSGGGGSEVKLEQSGPSLVQPSQSLSITCTV

SGFSLTNFGVHWVRQSPGKGLEWLGLIWRGGSTDYNAAFMSRLSITKDN

SKSQVFFKMNSLQADDTAIYYCAKMGITYYFDYWGQGTTLTVSS.

In some embodiments, the anti-CD19 scFv comprises an amino acid sequence:

(SEQ ID NO:196)
DIVLTQSHKFMSTSVGDRVSVTCKASQNVGTNVAWYQQKPGQSPKALIF

SASYRNSGVPDRFTGSGSGTDFTLTITNVQSEDLLEYFCQQYNTYPYTF

GGGTKLEIKRGGGGSGGGGSGGGGSQVKLQQSGDDLVKPGASVKLSCKA

SGYTFTSYWINWIKQRPGQGLEWIGHIAPGTGSTYYSEMFKDKATLTVD

TPSSSAYIQLSSLSSEDSAVYFCAREGGRYYTLDCWGQGTSVTVSS.

In some embodiments, the anti-CD19 scFv comprises an amino acid sequence:

(SEQ ID NO: 197)
DIVLTQSHKFMSTSVGDRVSVTCKASQNVGTNVAWYQQKPGQSPKALIF

SASYRNSGVPDRFTGSGSGTDFTLTITNVQSEDLLEYFCQQYNTYPYTF

GGGTKLEIKRGGGGSGGGGSGGGGSQVQLEESGPGLVKPSQTVSLTCTV

TGISITTGNYRWSWIRQFPGNKLEWIGYIYYSGTITYNPSLTSRTTITR

DTSKNQFFLEMNSLTAEDTATYYCARWLNNFDVWGTGTTVTVS.

In some embodiments, the anti-CD19 scFv comprises an amino acid sequence:

(SEQ ID NO: 198)
DIVLTQSHKFMSTSVGDRVSVTCKASQNVGTNVAWYQQKPGQSPKALIF
SASYRNSGVPDRFTGSGSGTDFTLTITNVQSEDLLEYFCQQYNTYPYTF
GGGTKLEIKRGGGGSGGGGSGGGGSDVVMTQTPLTLSVTTGQPASISCK
SSQSLLNSDGKTFLNWLLQRPGQSPKRLIYLVSKLDSGVPDRFTGSGSG
TDFTLKICRVEAEDLGVYYCWQGTHFPYTFGGGTKLEIKR.

In some embodiments, the anti-CD19 scFv comprises an amino acid sequence:

(SEQ ID NO: 199)
DIVLTQSHKFMSTSVGDRVSVTCKASQNVGTNVAWYQQKPGQSPKALIF
SASYRNSGVPDRFTGSGSGTDFTLTITNVQSEDLLEYFCQQYNTYPYTF
GGGTKLEIKRGGGGSGGGGSGGGGSDIVMSQSPSSLAVSVGEKVTMSCK
SSQSLLYSSNQKNYLAWYQQKPGQSPKLLIYWASTRESGVPDRFTGSGS
GTDFTLTISSVKAEDLAVYYCQQYYSYPRTFGGGTKLEIKR.

In some embodiments, the anti-CD19 scFv comprises an amino acid sequence:

(SEQ ID NO: 200)
DIVLTQSHKFMSTSVGDRVSVTCKASQNVGTNVAWYQQKPGQSPKALIF
SASYRNSGVPDRFTGSGSGTDFTLTITNVQSEDLLEYFCQQYNTYPYTF
GGGTKLEIKRGGGGSGGGGSGGGGSDIVLTQSTSSLAVSVGEKVTMSCK
SSQSLLFGSNQKNYLAWYQQKLGQSPKLLIFWASTRESGVPDRFTGSGS
GTDFTLTISSVKAEDLAVYYCQQYYSYPFTFGSGTKLEIKR.

In some embodiments, the anti-CD19 scFv comprises an amino acid sequence:

(SEQ ID NO: 201)
DIVLTQSHKFMSTSVGDRVSVTCKASQNVGTNVAWYQQKPGQSPKALIF
SASYRNSGVPDRFTGSGSGTDFTLTITNVQSEDLLEYFCQQYNTYPYTF
GGGTKLEIKRGGGGSGGGGSGGGGSDIVLTQTNLTLSITIGQPASISCK
SSQSLLDSDGKTYLNWLLQRPGQSPKRLIYLVSKLDSGVPDRFTGSGSG
TDFTLKISRVGAEDLGIYYCWQGTHFPHTFGGGTKLEIKR.

In some embodiments, the anti-CD19 scFv comprises an amino acid sequence:

(SEQ ID NO: 202)
DIVLTQSHKFMSTSVGDRVSVTCKASQNVGTNVAWYQQKPGQSPKALIF
SASYRNSGVPDRFTGSGSGTDFTLTITNVQSEDLLEYFCQQYNTYPYTF
GGGTKLEIKRGGGGSGGGGSGGGGSDIVLTQSPAIMSASPGEKVTMTCR
ASSSVSSSYLHWYQQKSGASPKLWIYSTSNLASGVPARFSGSGSGTSYS
LTISSVEAEDAATYYCQQYSGYPLTFGAGTKLELKR.

In some embodiments, the anti-CD19 scFv comprises an amino acid sequence:

(SEQ ID NO: 203)
DIVMTQSPASLAVSLGQRATISCRASETIDNYGISFMNWFQQKPGQPPK
LLIYGASNQGSGVPARFSGSGSGTDFSLNIHPMEEDDTAMYFCQQNKEF
PWTFGGGTKLEIKRGGGGSGGGGSGGGGSEVKLEESGGGLVKPGGSLKL
SCAASGFTFSSYAMSWVRQTPEKRLEWVASISSGGSTYYPDSVKGRFTI
SRDNARNTLYLQMSSLRSEDTAMYYCARGRDGYSLYFDYWGQGTTLTVS
S.

In some embodiments, the anti-CD19 scFv comprises an amino acid sequence:

(SEQ ID NO: 204)
DIVMTQSPASLAVSLGQRATISCRASETIDNYGISFMNWFQQKPGQPPK
LLIYGASNQGSGVPARFSGSGSGTDFSLNIHPMEEDDTAMYFCQQNKEF
PWTFGGGTKLEIKRGGGGSGGGGSGGGGSQVKLQESGGGLVKPGGSLKL
SCAASGFTFSSYAMSWVRQTPEKRLEWVAGISSGGSFTYYPDTVKGRFT
ISRDNARNTLYLQMSSLRSEDTAMYSCAREGVYSDYRAWFAYWGQGTLV
T.

In some embodiments, the anti-CD19 scFv comprises an amino acid sequence:

(SEQ ID NO: 205)
DIVMTQSPASLAVSLGQRATISCRASETIDNYGISFMNWFQQKPGQPPKL
LIYGASNQGSGVPARFSGSGSGTDFSLNIHPMEEDDTAMYFCQQNKEFPW
TFGGGTKLEIKRGGGGSGGGGSGGGGSEVKLEQSGPSLVQPSQSLSITCTV
SGFSLTNFGVHWVRQSPGKGLEWLGLIWRGGSTDYNAAFMSRLSITKDNS
KSQVFFKMNSLQADDTAIYYCAKMGITYYFDYWGQGTTLTVSS.

In some embodiments, the anti-CD19 scFv comprises an amino acid sequence:

(SEQ ID NO: 206)
DIVMTQSPASLAVSLGQRATISCRASETIDNYGISFMNWFQQKPGQPPK
LLIYGASNQGSGVPARFSGSGSGTDFSLNIHPMEEDDTAMYFCQQNKEF
PWTFGGGTKLEIKRGGGGSGGGGSGGGGSQVKLQQSGDDLVKPGASVKL
SCKASGYTFTSYWINWIKQRPGQGLEWIGHIAPGTGSTYYSEMFKDKAT
LTVDTPSSSAYIQLSSLSSEDSAVYFCAREGGRYYTLDCWGQGTSVTVS
S.

In some embodiments, the anti-CD19 scFv comprises an amino acid sequence:

(SEQ ID NO: 207)
DIVMTQSPASLAVSLGQRATISCRASETIDNYGISFMNWFQQKPGQPPK
LLIYGASNQGSGVPARFSGSGSGTDFSLNIHPMEEDDTAMYFCQQNKEF
PWTFGGGTKLEIKRGGGGSGGGGSGGGGSQVQLEESGPGLVKPSQTVSL

TCTVTGISITTGNYRWSWIRQFPGNKLEWIGYIYYSGTITYNPSLTSRT

TITRDTSKNQFFLEMNSLTAEDTATYYCARWLNNFDVWGTGTTVTVS.

In some embodiments, the anti-CD19 scFv comprises an amino acid sequence:

(SEQ ID NO: 208)
DIVMTQSPASLAVSLGQRATISCRASETIDNYGISFMNWFQQKPGQPPK

LLIYGASNQGSGVPARFSGSGSGTDFSLNIHPMEEDDTAMYFCQQNKEF

PWTFGGGTKLEIKRGGGGSGGGGSGGGGSDVVMTQTPLTLSVTTGQPAS

ISCKSSQSLLNSDGKTFLNWLLQRPGQSPKRLIYLVSKLDSGVPDRFTG

SGSGTDFTLKICRVEAEDLGVYYCWQGTHFPYTFGGGTKLEIKR.

In some embodiments, the anti-CD19 scFv comprises an amino acid sequence:

(SEQ ID NO: 209)
DIVMTQSPASLAVSLGQRATISCRASETIDNYGISFMNWFQQKPGQPPK

LLIYGASNQGSGVPARFSGSGSGTDFSLNIHPMEEDDTAMYFCQQNKEF

PWTFGGGTKLEIKRGGGGSGGGGSGGGGSDIVMSQSPSSLAVSVGEKVT

MSCKSSQSLLYSSNQKNYLAWYQQKPGQSPKLLIYWASTRESGVPDRFT

GSGSGTDFTLTISSVKAEDLAVYYCQQYYSYPRTFGGGTKLEIKR.

In some embodiments, the anti-CD19 scFv comprises an amino acid sequence:

(SEQ ID NO: 210)
DIVMTQSPASLAVSLGQRATISCRASETIDNYGISFMNWFQQKPGQPPK

LLIYGASNQGSGVPARFSGSGSGTDFSLNIHPMEEDDTAMYFCQQNKEF

PWTFGGGTKLEIKRGGGGSGGGGSGGGGSDIVLTQSTSSLAVSVGEKVT

MSCKSSQSLLFGSNQKNYLAWYQQKLGQSPKLLIFWASTRESGVPDRFT

GSGSGTDFTLTISSVKAEDLAVYYCQQYYSYPFTFGSGTKLEIKR.

In some embodiments, the anti-CD19 scFv comprises an amino acid sequence:

(SEQ ID NO: 211)
DIVMTQSPASLAVSLGQRATISCRASETIDNYGISFMNWFQQKPGQPPK

LLIYGASNQGSGVPARFSGSGSGTDFSLNIHPMEEDDTAMYFCQQNKEF

PWTFGGGTKLEIKRGGGGSGGGGSGGGGSDIVLTQTNLTLSITIGQPAS

ISCKSSQSLLDSDGKTYLNWLLQRPGQSPKRLIYLVSKLDSGVPDRFTG

SGSGTDFTLKISRVGAEDLGIYYCWQGTHFPHTFGGGTKLEIKR.

In some embodiments, the anti-CD19 scFv comprises an amino acid sequence:

(SEQ ID NO: 212)
DIVMTQSPASLAVSLGQRATISCRASETIDNYGISFMNWFQQKPGQPPK

LLIYGASNQGSGVPARFSGSGSGTDFSLNIHPMEEDDTAMYFCQQNKEF

PWTFGGGTKLEIKRGGGGSGGGGSGGGGSDIVLTQSPAIMSASPGEKVT

MTCRASSSVSSSYLHWYQQKSGASPKLWIYSTSNLASGVPARFSGSGSG

TSYSLTISSVEAEDAATYYCQQYSGYPLTFGAGTKLELKR.

In some embodiments, the anti-CD19 scFv comprises an amino acid sequence:

(SEQ ID NO: 213)
DIVMTQSHKFMSTSVGGRVSVTCKASQNVDTNVAWYQQKPGQSPKALIY

SASYRYSGVPDRFTGSGSGTDFTLTITNVQSEDLAEYFCQQYNSYPLTF

GAGTKLELKRGGGGSGGGGSGGGGSEVKLEESGGGLVKPGGSLKLSCAA

SGFTFSSYAMSWVRQTPEKRLEWVASISSGGSTYYPDSVKGRFTISRDN

ARNTLYLQMSSLRSEDTAMYYCARGRDGYSLYFDYWGQGTTLTVSS.

In some embodiments, the anti-CD19 scFv comprises an amino acid sequence:

(SEQ ID NO: 214)
DIVMTQSHKFMSTSVGGRVSVTCKASQNVDTNVAWYQQKPGQSPKALIY

SASYRYSGVPDRFTGSGSGTDFTLTITNVQSEDLAEYFCQQYNSYPLTF

GAGTKLELKRGGGGSGGGGGGGSQVKLQESGGGLVKPGGSLKLSCAAS

GFTFSSYAMSWVRQTPEKRLEWVAGISSGGSFTYYPDTVKGRFTISRDN

ARNTLYLQMSSLRSEDTAMYSCAREGVYSDYRAWFAYWGQGTLVT.

In some embodiments, the anti-CD19 scFv comprises an amino acid sequence:

(SEQ ID NO: 215)
DIVMTQSHKFMSTSVGGRVSVTCKASQNVDTNVAWYQQKPGQSPKALI

YSASYRYSGVPDRFTGSGSGTDFTLTITNVQSEDLAEYFCQQYNSYPL

TFGAGTKLELKRGGGGSGGGGSGGGGSEVKLEQSGPSLVQPSQSLSIT

CTVSGFSLTNFGVHWVRQSPGKGLEWLGLIWRGGSTDYNAAFMSRLSI

TKDNSKSQVFFKMNSLQADDTAIYYCAKMGITYYFDYWGQGTTLTVSS.

In some embodiments, the anti-CD19 scFv comprises an amino acid sequence:

(SEQ ID NO: 216)
DIVMTQSHKFMSTSVGGRVSVTCKASQNVDTNVAWYQQKPGQSPKALI

YSASYRYSGVPDRFTGSGSGTDFTLTITNVQSEDLAEYFCQQYNSYPL

TFGAGTKLELKRGGGGSGGGGSGGGGSQVKLQQSGDDLVKPGASVKLS

CKASGYTFTSYWINWIKQRPGQGLEWIGHIAPGTGSTYYSEMFKDKAT

LTVDTPSSSAYIQLSSLSSEDSAVYFCAREGGRYYTLDCWGQGTSVTV

SS.

In some embodiments, the anti-CD19 scFv comprises an amino acid sequence:

(SEQ ID NO: 217)
DIVMTQSHKFMSTSVGGRVSVTCKASQNVDTNVAWYQQKPGQSPKALI

YSASYRYSGVPDRFTGSGSGTDFTLTITNVQSEDLAEYFCQQYNSYPL

TFGAGTKLELKRGGGGSGGGGSGGGGSQVQLEESGPGLVKPSQTVSLT

CTVTGISITTGNYRWSWIRQFPGNKLEWIGYIYYSGTITYNPSLTSRT

TITRDTSKNQFFLEMNSLTAEDTATYYCARWLNNFDVWGTGTTVTVS.

In some embodiments, the anti-CD19 scFv comprises an amino acid sequence:

(SEQ ID NO: 218)
DIVMTQSHKFMSTSVGGRVSVTCKASQNVDTNVAWYQQKPGQSPKALI

YSASYRYSGVPDRFTGSGSGTDFTLTITNVQSEDLAEYFCQQYNSYPL

TFGAGTKLELKRGGGGSGGGGSGGGGSDVVMTQTPLTLSVTTGQPASI

SCKSSQSLLNSDGKTFLNWLLQRPGQSPKRLIYLVSKLDSGVPDRFTG

SGSGTDFTLKICRVEAEDLGVYYCWQGTHFPYTFGGGTKLEIKR.

In some embodiments, the anti-CD19 scFv comprises an amino acid sequence:

(SEQ ID NO: 219)
DIVMTQSHKFMSTSVGGRVSVTCKASQNVDTNVAWYQQKPGQSPKALIYS

ASYRYSGVPDRFTGSGSGTDFTLTITNVQSEDLAEYFCQQYNSYPLTFGA

GTKLELKRGGGGSGGGGSGGGGSDIVMSQSPSSLAVSVGEKVTMSCKSSQ

SLLYSSNQKNYLAWYQQKPGQSPKLLIYWASTRESGVPDRFTGSGSGTDF

TLTISSVKAEDLAVYYCQQYYSYPRTFGGGTKLEIKR

In some embodiments, the anti-CD19 scFv comprises an amino acid sequence:

(SEQ ID NO: 220)
DIVMTQSHKFMSTSVGGRVSVTCKASQNVDTNVAWYQQKPGQSPKALIYS

ASYRYSGVPDRFTGSGSGTDFTLTITNVQSEDLAEYFCQQYNSYPLTFGA

GTKLELKRGGGGSGGGGSGGGGSDIVLTQSTSSLAVSVGEKVTMSCKSSQ

SLLFGSNQKNYLAWYQQKLGQSPKLLIFWASTRESGVPDRFTGSGSGTDF

TLTISSVKAEDLAVYYCQQYYSYPFTFGSGTKLEIKR

In some embodiments, the anti-CD19 scFv comprises an amino acid sequence:

(SEQ ID NO: 221)
DIVMTQSHKFMSTSVGGRVSVTCKASQNVDTNVAWYQQKPGQSPKALIYS

ASYRYSGVPDRFTGSGSGTDFTLTITNVQSEDLAEYFCQQYNSYPLTFGA

GTKLELKRGGGGSGGGGSGGGGSDIVLTQTNLTLSITIGQPASISCKSSQ

SLLDSDGKTYLNWLLQRPGQSPKRLIYLVSKLDSGVPDRFTGSGSGTDFT

LKISRVGAEDLGIYYCWQGTHFPHTFGGGTKLEIKR

In some embodiments, the anti-CD19 scFv comprises an amino acid sequence:

(SEQ ID NO: 222)
DIVMTQSHKFMSTSVGGRVSVTCKASQNVDTNVAWYQQKPGQSPKALIYS

ASYRYSGVPDRFTGSGSGTDFTLTITNVQSEDLAEYFCQQYNSYPLTFGA

GTKLELKRGGGGSGGGGSGGGGSDIVLTQSPAIMSASPGEKVTMTCRASS

SVSSSYLHWYQQKSGASPKLWIYSTSNLASGVPARFSGSGSGTSYSLTIS

SVEAEDAATYYCQQYSGYPLTFGAGTKLELKR

In some embodiments, the anti-CD19 scFv comprises an amino acid sequence:

(SEQ ID NO: 223)
DIVLTQTHKFMSTSVGDRVSITCKASQDVGTAVAWYQQKPGQSPKLLIYW

ASTRHTGVPDRFTGSGSGTDFTLTISNVQSEDLADYFCQQYSSYPLTFGG

GTKLEIKGGGGSGGGGSGGGGSEVKLEESGGGLVKPGGSLKLSCAASGFT

FSSYAMSWVRQTPEKRLEWVASISSGGSTYYPDSVKGRFTISRDNARNTL

YLQMSSLRSEDTAMYYCARGRDGYSLYFDYWGQGTTLTVSS.

In some embodiments, the anti-CD19 scFv comprises an amino acid sequence:

(SEQ ID NO: 224)
DIVLTQTHKFMSTSVGDRVSITCKASQDVGTAVAWYQQKPGQSPKLLIYW

ASTRHTGVPDRFTGSGSGTDFTLTISNVQSEDLADYFCQQYSSYPLTFGG

GTKLEIKGGGGSGGGGSGGGGSQVKLQESGGGLVKPGGSLKLSCAASGFT

FSSYAMSWVRQTPEKRLEWVAGISSGGSFTYYPDTVKGRFTISRDNARNT

LYLQMSSLRSEDTAMYSCAREGVYSDYRAWFAYWGQGTLVT.

In some embodiments, the anti-CD19 scFv comprises an amino acid sequence:

(SEQ ID NO: 225)
DIVLTQTHKFMSTSVGDRVSITCKASQDVGTAVAWYQQKPGQSPKLLIYW

ASTRHTGVPDRFTGSGSGTDFTLTISNVQSEDLADYFCQQYSSYPLTFGG

GTKLEIKGGGGSGGGGSGGGGSEVKLEQSGPSLVQPSQSLSITCTVSGFS

LTNFGVHWVRQSPGKGLEWLGLIWRGGSTDYNAAFMSRLSITKDNSKSQV

FFKMNSLQADDTAIYYCAKMGITYYFDYWGQGTTLTVSS.

In some embodiments, the anti-CD19 scFv comprises an amino acid sequence:

(SEQ ID NO: 226)
DIVLTQTHKFMSTSVGDRVSITCKASQDVGTAVAWYQQKPGQSPKLLIYW

ASTRHTGVPDRFTGSGSGTDFTLTISNVQSEDLADYFCQQYSSYPLTFGG

GTKLEIKGGGGSGGGGSGGGGSQVKLQQSGDDLVKPGASVKLSCKASGYT

FTSYWINWIKQRPGQGLEWIGHIAPGTGSTYYSEMFKDKATLTVDTPSSS

AYIQLSSLSSEDSAVYFCAREGGRYYTLDCWGQGTSVTVSS.

In some embodiments, the anti-CD19 scFv comprises an amino acid sequence:

(SEQ ID NO: 227)
DIVLTQTHKFMSTSVGDRVSITCKASQDVGTAVAWYQQKPGQSPKLLIYW

ASTRHTGVPDRFTGSGSGTDFTLTISNVQSEDLADYFCQQYSSYPLTFGG

GTKLEIKGGGGSGGGGSGGGGSQVQLEESGPGLVKPSQTVSLTCTVTGIS

ITTGNYRWSWIRQFPGNKLEWIGYIYYSGTITYNPSLTSRTTITRDTSKN

QFFLEMNSLTAEDTATYYCARWLNNFDVWGTGTTVTVS.

In some embodiments, the anti-CD19 scFv comprises an amino acid sequence:

(SEQ ID NO: 228)
DIVLTQTHKFMSTSVGDRVSITCKASQDVGTAVAWYQQKPGQSPKLLIYW
ASTRHTGVPDRFTGSGSGTDFTLTISNVQSEDLADYFCQQYSSYPLTFGG
GTKLEIKGGGGSGGGGSGGGGSDWVMTQTPLTLSVTTGQPASISCKSSQS
LLNSDGKTFLNWLLQRPGQSPKRLIYLVSKLDSGVPDRFTGSGSGTDFTL
KICRVEAEDLGVYYCWQGTHEPYTFGGGTKLEIKR.

In some embodiments, the anti-CD19 scFv comprises an amino acid sequence:

(SEQ ID NO: 229)
DIVLTQTHKFMSTSVGDRVSITCKASQDVGTAVAWYQQKPGQSPKLLIYW
ASTRHTGVPDRFTGSGSGTDFTLTISNVQSEDLADYFCQQYSSYPLTFGG
GTKLEIKGGGGSGGGGSGGGGSDIVMSQSPSSLAVSVGEKVTMSCKSSQS
LLYSSNQKNYLAWYQQKPGQSPKLLIYWASTRESGVPDRFTGSGSGTDFT
LTISSVKAEDLAVYYCQQYYSYPRTFGGGTKLEIKR.

In some embodiments, the anti-CD19 scFv comprises an amino acid sequence:

(SEQ ID NO: 230)
DIVLTQTHKFMSTSVGDRVSITCKASQDVGTAVAWYQQKPGQSPKLLIYW
ASTRHTGVPDRFTGSGSGTDFTLTISNVQSEDLADYFCQQYSSYPLTFGG
GTKLEIKGGGGSGGGGSGGGGSDIVLTQSTSSLAVSVGEKVTMSCKSSQS
LLFGSNQKNYLAWYQQKLGQSPKLLIFWASTRESGVPDRFTGSGSGTDFT
LTISSVKAEDLAVYYCQQYYSYPFTFGSGTKLEIKR.

In some embodiments, the anti-CD19 scFv comprises an amino acid sequence:

(SEQ ID NO: 231)
DIVLTQTHKFMSTSVGDRVSITCKASQDVGTAVAWYQQKPGQSPKLLIYW
ASTRHTGVPDRFTGSGSGTDFTLTISNVQSEDLADYFCQQYSSYPLTFGG
GTKLEIKGGGGSGGGGGGGGSDIVLTQTNLTLSITIGQPASISCKSSQSL
LDSDGKTYLNWLLQRPGQSPKRLIYLVSKLDSGVPDRFTGSGSGTDFTLK
ISRVGAEDLGIYYCWQGTHFPHTFGGGTKLEIKR.

In some embodiments, the anti-CD19 scFv comprises an amino acid sequence:

(SEQ ID NO: 232)
DIVLTQTHKFMSTSVGDRVSITCKASQDVGTAVAWYQQKPGQSPKLLIYW
ASTRHTGVPDRFTGSGSGTDFTLTISNVQSEDLADYFCQQYSSYPLTFGG
GTKLEIKGGGGSGGGGSGGGGSDIVLTQSPAIMSASPGEKVTMTCRASSS
VSSSYLHWYQQKSGASPKLWIYSTSNLASGVPARFSGSGSGTSYSLTISS
VEAEDAATYYCQQYSGYPLTFGAGTKLELKR.

In some embodiments, the anti-CD19 scFv comprises an amino acid sequence:

(SEQ ID NO: 233)
DIVITQSHKFMPTSVGDRVSITCKASQDVSTAVAWYQQKPGQSPKLLIYS
ASYRYTGVPDRFTGSGSGTDFTFTISSVQAEDLAVYYCQQHYSTPYTFGG
GTKLEIKRGGGGSGGGGSGGGGSEVKLEESGGGLVKPGGSLKLSCAASGF
TFSSYAMSWVRQTPEKRLEWVASISSGGSTYYPDSVKGRFTISRDNARNT
LYLQMSSLRSEDTAMYYCARGRDGYSLYFDYWGQGTTLTVSS.

In some embodiments, the anti-CD19 scFv comprises an amino acid sequence:

(SEQ ID NO: 234)
DIVITQSHKFMPTSVGDRVSITCKASQDVSTAVAWYQQKPGQSPKLLIYS
ASYRYTGVPDRFTGSGSGTDFTFTISSVQAEDLAVYYCQQHYSTPYTFGG
GTKLEIKRGGGGSGGGGSGGGGSQVKLQESGGGLVKPGGSLKLSCAASGF
TFSSYAMSWVRQTPEKRLEWVAGISSGGSFTYYPDTVKGRFTISRDNARN
TLYLQMSSLRSEDTAMYSCAREGVYSDYRAWFAYWGQGTLVT.

In some embodiments, the anti-CD19 scFv comprises an amino acid sequence:

(SEQ ID NO: 235)
DIVITQSHKFMPTSVGDRVSITCKASQDVSTAVAWYQQKPGQSPKLLIYS
ASYRYTGVPDRFTGSGSGTDFTFTISSVQAEDLAVYYCQQHYSTPYTFGG
GTKLEIKRGGGGSGGGGSGGGGSEVKLEQSGPSLVQPSQSLSITCTVSGF
SLTNFGVHWVRQSPGKGLEWLGLIWRGGSTDYNAAFMSRLSITKDNSKSQ
VFFKMNSLQADDTAIYYCAKMGITYYFDYWGQGTTLTVSS.

In some embodiments, the anti-CD19 scFv comprises an amino acid sequence:

(SEQ ID NO: 236)
DIVITQSHKFMPTSVGDRVSITCKASQDVSTAVAWYQQKPGQSPKLLIYS
ASYRYTGVPDRFTGSGSGTDFTFTISSVQAEDLAVYYCQQHYSTPYTFGG
GTKLEIKRGGGGSGGGGSGGGGSQVKLQQSGDDLVKPGASVKLSCKASGY
TFTSYWINWIKQRPGQGLEWIGHIAPGTGSTYYSEMFKDKATLTVDTPSS
SAYIQLSSLSSEDSAVYFCAREGGRYYTLDCWGQGTSVTVSS.

In some embodiments, the anti-CD19 scFv comprises an amino acid sequence:

(SEQ ID NO: 237)
DIVITQSHKFMPTSVGDRVSITCKASQDVSTAVAWYQQKPGQSPKLLIYS
ASYRYTGVPDRFTGSGSGTDFTFTISSVQAEDLAVYYCQQHYSTPYTFGG
GTKLEIKRGGGGSGGGGSGGGGSQVQLEESGPGLVKPSQTVSLTCTVTGI
SITTGNYRWSWIRQFPGNKLEWIGYIYYSGTITYNPSLTSRTTITRDTSK
NQFFLEMNSLTAEDTATYYCARWLNNFDVWGTGTTVTVS.

In some embodiments, the anti-CD19 scFv comprises an amino acid sequence:

(SEQ ID NO: 238)
DIVITQSHKFMPTSVGDRVSITCKASQDVSTAVAWYQQKPGQSPKLLIYS
ASYRYTGVPDRFTGSGSGTDFTFTISSVQAEDLAVYYCQQHYSTPYTFGG
GTKLEIKRGGGGSGGGGSGGGGSDVVMTQTPLTLSVTTGQPASISCKSSQ
SLLNSDGKTFLNWLLQRPGQSPKRLIYLVSKLDSGVPDRFTGSGSGTDFT
LKICRVEAEDLGVYYCWQGTHFPYTFGGGTKLEIKR.

In some embodiments, the anti-CD19 scFv comprises an amino acid sequence:

(SEQ ID NO: 239)
DIVITQSHKFMPTSVGDRVSITCKASQDVSTAVAWYQQKPGQSPKLLIYS
ASYRYTGVPDRFTGSGSGTDFTFTISSVQAEDLAVYYCQQHYSTPYTFGG
GTKLEIKRGGGGSGGGGSGGGGSDIVMSQSPSSLAVSVGEKVTMSCKSSQ
SLLYSSNQKNYLAWYQQKPGQSPKLLIYWASTRESGVPDRFTGSGSGTDF
TLTISSVKAEDLAVYYCQQYYSYPRTFGGGTKLEIKR.

In some embodiments, the anti-CD19 scFv comprises an amino acid sequence:

(SEQ ID NO: 240)
DIVITQSHKFMPTSVGDRVSITCKASQDVSTAVAWYQQKPGQSPKLLIYS
ASYRYTGVPDRFTGSGSGTDFTFTISSVQAEDLAVYYCQQHYSTPYTFGG
GTKLEIKRGGGGSGGGGSGGGGSDIVLTQSTSSLAVSVGEKVTMSCKSSQ
SLLFGSNQKNYLAWYQQKLGQSPKLLIFWASTRESGVPDRFTGSGSGTDF
TLTISSVKAEDLAVYYCQQYYSYPFTFGSGTKLEIKR.

In some embodiments, the anti-CD19 scFv comprises an amino acid sequence:

(SEQ ID NO: 241)
DIVITQSHKFMPTSVGDRVSITCKASQDVSTAVAWYQQKPGQSPKLLIYS
ASYRYTGVPDRFTGSGSGTDFTFTISSVQAEDLAVYYCQQHYSTPYTFGG
GTKLEIKRGGGGSGGGGSGGGGSDIVLTQTNLTLSITIGQPASISCKSSQ
SLLDSDGKTYLNWLLQRPGQSPKRLIYLVSKLDSGVPDRFTGSGSGTDFT
LKISRVGAEDLGIYYCWQGTHFPHTFGGGTKLEIKR.

In some embodiments, the anti-CD19 scFv comprises an amino acid sequence:

(SEQ ID NO: 242)
DIVITQSHKFMPTSVGDRVSITCKASQDVSTAVAWYQQKPGQSPKLLIYS
ASYRYTGVPDRFTGSGSGTDFTFTISSVQAEDLAVYYCQQHYSTPYTFGG
GTKLEIKRGGGGSGGGGSGGGGSDIVLTQSPAIMSASPGEKVTMTCRASS
SVSSSYLHWYQQKSGASPKLWIYSTSNLASGVPARFSGSGSGTSYSLTIS
SVEAEDAATYYCQQYSGYPLTFGAGTKLELKR.

In some embodiments, the anti-CD19 scFv comprises an amino acid sequence:

(SEQ ID NO: 243)
DVVMTQTPLTLSVTTGQPASISCKSSQSLLNSDGKTFLNWLLQRPGQSPK
RLIYLVSKLDSGVPDRFTGSGSGTDFTLKICRVEAEDLGVYYCWQGTHFP
YTFGGGTKLEIKRGGGGSGGGGSGGGGSEVKLEESGGGLVKPGGSLKLSC
AASGFTFSSYAMSWVRQTPEKRLEWVASISSGGSTYYPDSVKGRFTISRD
NARNTLYLQMSSLRSEDTAMYYCARGRDGYSLYFDYWGQGTTLTVSS.

In some embodiments, the anti-CD19 scFv comprises an amino acid sequence:

(SEQ ID NO: 244)
DVVMTQTPLTLSVTTGQPASISCKSSQSLLNSDGKTFLNWLLQRPGQSPK
RLIYLVSKLDSGVPDRFTGSGSGTDFTLKICRVEAEDLGVYYCWQGTHFP
YTFGGGTKLEIKRGGGGSGGGGSGGGGSQVKLQESGGGLVKPGGSLKLSC
AASGFTFSSYAMSWVRQTPEKRLEWVAGISSGGSFTYYPDTVKGRFTISR
DNARNTLYLQMSSLRSEDTAMYSCAREGVYSDYRAWFAYWGQGTLVTVS.

In some embodiments, the anti-CD19 scFv comprises an amino acid sequence:

(SEQ ID NO: 245)
DVVMTQTPLTLSVTTGQPASISCKSSQSLLNSDGKTFLNWLLQRPGQSPK
RLIYLVSKLDSGVPDRFTGSGSGTDFTLKICRVEAEDLGVYYCWQGTHFP
YTFGGGTKLEIKRGGGGSGGGGSGGGGSEVKLEQSGPSLVQPSQSLSITC
TVSGFSLTNFGVHWVRQSPGKGLEWLGLIWRGGSTDYNAAFMSRLSITKD
NSKSQVFFKMNSLQADDTAIYYCAKMGITYYFDYWGQGTTLTVSS.

In some embodiments, the anti-CD19 scFv comprises an amino acid sequence:

(SEQ ID NO: 246)
DVVMTQTPLTLSVTTGQPASISCKSSQSLLNSDGKTFLNWLLQRPGQSPK
RLIYLVSKLDSGVPDRFTGSGSGTDFTLKICRVEAEDLGVYYCWQGTHFP
YTFGGGTKLEIKRGGGGSGGGGSGGGGSQVKLQQSGDDLVKPGASVKLSC
KASGYTFTSYWINWIKQRPGQGLEWIGHIAPGTGSTYYSEMFKDKATLTV
DTPSSSAYIQLSSLSSEDSAVYFCAREGGRYYTLDCWGQGTSVTVSS.

In some embodiments, the anti-CD19 scFv comprises an amino acid sequence:

(SEQ ID NO: 247)
DVVMTQTPLTLSVTTGQPASISCKSSQSLLNSDGKTFLNWLLQRPGQSPK
RLIYLVSKLDSGVPDRFTGSGSGTDFTLKICRVEAEDLGVYYCWQGTHFP
YTFGGGTKLEIKRGGGGSGGGGSGGGGSQVQLEESGPGLVKPSQTVSLTC
TVTGISITTGNYRWSWIRQFPGNKLEWIGYIYYSGTITYNPSLTSRTTIT
RDTSKNQFFLEMNSLTAEDTATYYCARWLNNFDVWGTGTTVTVS.

In some embodiments, the anti-CD19 scFv comprises an amino acid sequence:

In some embodiments, the anti-CD19 scFv comprises an amino acid sequence:

(SEQ ID NO: 248)
DVVMTQTPLTLSVTTGQPASISCKSSQSLLNSDGKTFLNWLLQRPGQSPK
RLIYLVSKLDSGVPDRFTGSGSGTDFTLKICRVEAEDLGVYYCWQGTHFP
YTFGGGTKLEIKRGGGGSGGGGSGGGGSEVMLVESGGGLVKPGGSLKLSC
AASGFTFSRYAMSWNRQTPEKRLEWVATISPGGGYIYYSDSVKGRFTISR
DNARNTLYLQMSSLRSEDTAMYYCAGDYVDYWGQGTTLTVSS.

In some embodiments, the anti-CD19 scFv comprises an amino acid sequence:

(SEQ ID NO: 249)
DWVMTQTPLTLSVTTGQPASISCKSSQSLLNSDGKTFLNWLLQRPGQSP
KRLIYLVSKLDSGVPDRFTGSGSGTDFTLKICRVEAEDLGVYYCWQGTH
FPYTFGGGTKLEIKRGGGGSGGGGSGGGGSQVQLQESGPGLVKPSQSLS
LTCTVTGYSITSDYAWNWIRQFPGNKLEWMGYISYSGSTTYNPSLKGRI
SFTRDTSKNQFFLHLKSVTTEDSATYYCARNWVYAMDYWGQGTSVTVSS.

In some embodiments, the anti-CD19 scFv comprises an amino acid sequence:

(SEQ ID NO: 250)
DWVMTQTPLTLSVTTGQPASISCKSSQSLLNSDGKTFLNWLLQRPGQSP
KRLIYLVSKLDSGVPDRFTGSGSGTDFTLKICRVEAEDLGVYYCWQGTH
FPYTFGGGTKLEIKRGGGGSGGGGSGGGGSEVKLQQSGPVLVKPGASVK
ISCKASGYTFTDYYYMNWVKQSHGKSLEWIGYIYPNNSGTSYNQKFRGK
ATLTVDKSSSTAYMEVRSLTSEDSAVYYCARYYDGFNAGFAYWGQGTLV
TVSA.

In some embodiments, the anti-CD19 scFv comprises an amino acid sequence:

(SEQ ID NO: 251)
DWVMTQTPLTLSVTTGQPASISCKSSQSLLNSDGKTFLNWLLQRPGQSP
KRLIYLVSKLDSGVPDRFTGSGSGTDFTLKICRVEAEDLGVYYCWQGTH
FPYTFGGGTKLEIKRGGGGSGGGGSGGGGSQVQLEESGPGLVAPSQSLS
ITCTVSGFSLSRYSVHWVRQPPGKGLEWLGMIWVNGNTDYNSALKSRLN
INKDNSKSQVFLKMNSLQTDDTAMYYCATYYGNYDSFTYWGQGTLVTVS
A.

In some embodiments, the anti-CD19 scFv comprises an amino acid sequence:

(SEQ ID NO: 252)
DWMTQTPLTLSVTTGQPASISCKSSQSLLNSDGKTFLNWLLQRPGQSPK
RLIYLVSKLDSGVPDRFTGSGSGTDFTLKICRVEAEDLGVYYCWQGTHF
PYTFGGGTKLEIKRGGGGSGGGGSGGGGSEVQLQESGAELARPGASVKM
SCKASGYTFTSYWMHWVKQRPGQGLEWIGAIYPGNSDTSYNQKFKGKAK
LTAVTSASTAYMELSSLTNEDSAVYYCTTSLAYWGQGTLVTVSA.

In some embodiments, the anti-CD19 scFv comprises an amino acid sequence:

(SEQ ID NO: 253)
DIVMSQSPSSLAVSVGEKVTMSCKSSQSLLYSSNQKNYLAWYQQKPGQS
PKLLIYWASTRESGVPDRFTGSGSGTDFTLTISSVKAEDLAVYYCQQYY
SYPRTFGGGTKLEIKRGGGGSGGGGSGGGGSEVKLEESGGGLVKPGGSL
KLSCAASGFTFSSYAMSWVRQTPEKRLEWVASISSGGSTYYPDSVKGRF
TISRDNARNTLYLQMSSLRSEDTAMYYCARGRDGYSLYFDYWGQGTTLT
VSS.

In some embodiments, the anti-CD19 scFv comprises an amino acid sequence:

(SEQ ID NO: 254)
DIVMSQSPSSLAVSVGEKVTMSCKSSQSLLYSSNQKNYLAWYQQKPGQS
PKLLIYWASTRESGVPDRFTGSGSGTDFTLTISSVKAEDLAVYYCQQYY
SYPRTFGGGTKLEIKRGGGGGGGGSGGGGSQVKLQESGGGLVKPGGSLK
LSCAASGFTFSSYAMSWRQTPEKRLEWVAGISSGGSFTYYPDTVKGRFT
ISRDNARNTLYLQMSSLRSEDTAMYSCAREGVYSDYRAWFAYWGQGTLV
T.

In some embodiments, the anti-CD19 scFv comprises an amino acid sequence:

(SEQ ID NO: 255)
DIVMSQSPSSLAVSVGEKVTMSCKSSQSLLYSSNQKNYLAWYQQKPGQS
PKLLIYWASTRESGVPDRFTGSGSGTDFTLTISSVKAEDLAVYYCQQYY
SYPRTFGGGTKLEIKRGGGGSGGGGSGGGGSEVKLEQSGPSLVQPSQSL
SITCTVSGFSLTNFGVHWVRQSPGKGLEWLGLIWRGGSTDYNAAFMSRL
SITKDNSKSQVFFKMNSLQADDTAIYYCAKMGITYYFDYWGQGTTLTVS
S.

In some embodiments, the anti-CD19 scFv comprises an amino acid sequence:

(SEQ ID NO: 256)
DIVMSQSPSSLAVSVGEKVTMSCKSSQSLLYSSNQKNYLAWYQQKPGQS
PKLLIYWASTRESGVPDRFTGSGSGTDFTLTISSVKAEDLAVYYCQQYY
SYPRTFGGGTKLEIKRGGGGSGGGGSGGGGSQVKLQQSGDDLVKPGASV
KLSCKASGYTFTSYWINWIKQRPGQGLEWIGHIAPGTGSTYYSEMFKDK
ATLTVDTPSSSAYIQLSSLSSEDSAVYFCAREGGRYYTLDCWGQGTSVT
VSS.

In some embodiments, the anti-CD19 scFv comprises an amino acid sequence:

(SEQ ID NO: 257)
DIVMSQSPSSLAVSVGEKVTMSCKSSQSLLYSSNQKNYLAWYQQKPGQS
PKLLIYWASTRESGVPDRFTGSGSGTDFTLTISSVKAEDLAVYYCQQYY
SYPRTFGGGTKLEIKRGGGGSGGGGSGGGGSQVQLEESGPGLVKPSQTV

SLTCTVTGISITTGNYRWSWIRQFPGNKLEWIGYIYYSGTITYNPSLTS

RTTITRDTSKNQFFLEMNSLTAEDTATYYCARWLNNFDVWGTGTTVTVS.

In some embodiments, the anti-CD19 scFv comprises an amino acid sequence:

(SEQ ID NO: 258)
DIVMSQSPSSLAVSVGEKVTMSCKSSQSLLYSSNQKNYLAWYQQKPGQS

PKLLIYWASTRESGVPDRFTGSGSGTDFTLTISSVKAEDLAVYYCQQYY

SYPRTFGGGTKLEIKRGGGSGGGGSGGGGSEVMLVESGGGLVKPGGSL

KLSCAASGFTFSRYAMSWNRQTPEKRLEWVATISPGGGYIYYSDSVKGR

FTISRDNARNTLYLQMSSLRSEDTAMYYCAGDYVDYWGQGTTLTVSS.

In some embodiments, the anti-CD19 scFv comprises an amino acid sequence:

(SEQ ID NO: 259)
DIVMSQSPSSLAVSVGEKVTMSCKSSQSLLYSSNQKNYLAWYQQKPGQS

PKLLIYWASTRESGVPDRFTGSGSGTDFTLTISSVKAEDLAVYYCQQYY

SYPRTFGGGTKLEIKRGGGGSGGGGSGGGGSQVQLQESGPGLVKPSQSL

SLTCTVTGYSITSDYAWNWIRQFPGNKLEWMGYISYSGSTTYNPSLKGR

ISFTRDTSKNQFFLHLKSVTTEDSATYYCARNWVYAMDYWGQGTSVTVS

S.

In some embodiments, the anti-CD19 scFv comprises an amino acid sequence:

(SEQ ID NO: 260)
DIVMSQSPSSLAVSVGEKVTMSCKSSQSLLYSSNQKNYLAWYQQKPGQS

PKLLIYWASTRESGVPDRFTGSGSGTDFTLTISSVKAEDLAVYYCQQYY

SYPRTFGGGTKLEIKRGGGSGGGGSGGGGSEVKLQQSGPVLVKPGASV

KISCKASGYTFTDYYYMNWKQSHGKSLEWIGYIYPNNSGTSYNQKFRGK

ATLTVDKSSSTAYMEVRSLTSEDSAVYYCARYYDGFNAGFAYWGQGTLV

TVSA.

In some embodiments, the anti-CD19 scFv comprises an amino acid sequence:

(SEQ ID NO: 261)
DIVMSQSPSSLAVSVGEKVTMSCKSSQSLLYSSNQKNYLAWYQQKPGQS

PKLLIYWASTRESGVPDRFTGSGSGTDFTLTISSVKAEDLAVYYCQQYY

SYPRTFGGGTKLEIKRGGGSGGGGSGGGGSQVQLEESGPGLVAPSQSL

SITCTVSGFSLSRYSVHWVRQPPGKGLEWLGMIWVNGNTDYNSALKSRL

NINKDNSKSQVFLKMNSLQTDDTAMYYCATYYGNYDSFTYWGQGTLVTV

SA.

In some embodiments, the anti-CD19 scFv comprises an amino acid sequence:

(SEQ ID NO: 262)
DIVMSQSPSSLAVSVGEKVTMSCKSSQSLLYSSNQKNYLAWYQQKPGQS

PKLLIYWASTRESGVPDRFTGSGSGTDFTLTISSVKAEDLAVYYCQQYY

SYPRTFGGGTKLEIKRGGGGSGGGGSGGGGSEVQLQESGAELARPGASV

KMSCKASGYTFTSYWMHWKQRPGQGLEWIGAIYPGNSDTSYNQKFKGKA

KLTAVTSASTAYMELSSLTNEDSAVYYCTTSLAYWGQGTLVTVSA.

In some embodiments, the anti-CD19 scFv comprises an amino acid sequence:

(SEQ ID NO: 263)
DIVLTQSTSSLAVSVGEKVTMSCKSSQSLLFGSNQKNYLAWYQQKLGQS

PKLLIFWASTRESGVPDRFTGSGSGTDFTLTISSVKAEDLAVYYCQQYY

SYPFTFGSGTKLEIKRGGGGSGGGGSGGGGSEVKLEESGGGLVKPGGSL

KLSCAASGFTFSSYAMSWVRQTPEKRLEWVASISSGGSTYYPDSVKGRF

TISRDNARNTLYLQMSSLRSEDTAMYYCARGRDGYSLYFDYWGQGTTLT

VSS.

In some embodiments, the anti-CD19 scFv comprises an amino acid sequence:

(SEQ ID NO: 264)
DIVLTQSTSSLAVSVGEKVTMSCKSSQSLLFGSNQKNYLAWYQQKLGQSP

KLLIFWASTRESGVPDRFTGSGSGTDFTLTISSVKAEDLAVYYCQQYYSY

PFTFGSGTKLEIKRGGGGSGGGGSGGGGSQVKLQESGGGLVKPGGSLKLS

CAASGFTFSSYAMSWVRQTPEKRLEWVAGISSGGSFTYYPDTVKGRFTIS

RDNARNTLYLQMSSLRSEDTAMYSCAREGVYSDYRAWFAYWGQGTLVTVS.

In some embodiments, the anti-CD19 scFv comprises an amino acid sequence:

(SEQ ID NO: 265)
DIVLTQSTSSLAVSVGEKVTMSCKSSQSLLFGSNQKNYLAWYQQKLGQSP

KLLIFWASTRESGVPDRFTGSGSGTDFTLTISSVKAEDLAVYYCQQYYSY

PFTFGSGTKLEIKRGGGGSGGGGSGGGGSEVKLEQSGPSLVQPSQSLSIT

CTVSGFSLTNFGVHWVRQSPGKGLEWLGLIWRGGSTDYNAAFMSRLSITK

DNSKSQVFFKMNSLQADDTAIYYCAKMGITYYFDYWGQGTTLTVSS.

In some embodiments, the anti-CD19 scFv comprises an amino acid sequence:

(SEQ ID NO: 266)
DIVLTQSTSSLAVSVGEKVTMSCKSSQSLLFGSNQKNYLAWYQQKLGQSP

KLLIFWASTRESGVPDRFTGSGSGTDFTLTISSVKAEDLAVYYCQQYYSY

PFTFGSGTKLEIKRGGGGSGGGGSGGGGSQVKLQQSGDDLVKPGASVKLS

CKASGYTFTSYWINWIKQRPGQGLEWIGHIAPGTGSTYYSEMFKDKATLT

VDTPSSSAYIQLSSLSSEDSAVYFCAREGGRYYTLDCWGQGTSVTVSS.

In some embodiments, the anti-CD19 scFv comprises an amino acid sequence:

(SEQ ID NO: 267)
DIVLTQSTSSLAVSVGEKVTMSCKSSQSLLFGSNQKNYLAWYQQKLGQSP
KLLIFWASTRESGVPDRFTGSGSGTDFTLTISSVKAEDLAVYYCQQYYSY
PFTFGSGTKLEIKRGGGGSGGGGSGGGGSQVQLEESGPGLVKPSQTVSLT
CTVTGISITTGNYRWSWIRQFPGNKLEWIGYIYYSGTITYNPSLTSRTTI
TRDTSKNQFFLEMNSLTAEDTATYYCARWLNNFDVWGTGTTVTVS.

In some embodiments, the anti-CD19 scFv comprises an amino acid sequence:

(SEQ ID NO: 268)
DIVLTQSTSSLAVSVGEKVTMSCKSSQSLLFGSNQKNYLAWYQQKLGQSP
KLLIFWASTRESGVPDRFTGSGSGTDFTLTISSVKAEDLAVYYCQQYYSY
PFTFGSGTKLEIKRGGGGSGGGGSGGGGSEVMLVESGGGLVKPGGSLKLS
CAASGFTFSRYAMSWNRQTPEKRLEWVATISPGGGYIYYSDSVKGRFTIS
RDNARNTLYLQMSSLRSEDTAMYYCAGDYVDYWGQGTTLTVSS.

In some embodiments, the anti-CD19 scFv comprises an amino acid sequence:

(SEQ ID NO: 269)
DIVLTQSTSSLAVSVGEKVTMSCKSSQSLLFGSNQKNYLAWYQQKLGQSP
KLLIFWASTRESGVPDRFTGSGSGTDFTLTISSVKAEDLAVYYCQQYYSY
PFTFGSGTKLEIKRGGGGSGGGGSGGGGSQVQLQESGPGLVKPSQSLSLT
CTVTGYSITSDYAWNWIRQFPGNKLEWMGYISYSGSTTYNPSLKGRISFT
RDTSKNQFFLHLKSVTTEDSATYYCARNWVYAMDYWGQGTSVTVSS.

In some embodiments, the anti-CD19 scFv comprises an amino acid sequence:

(SEQ ID NO: 270)
DIVLTQSTSSLAVSVGEKVTMSCKSSQSLLFGSNQKNYLAWYQQKLGQSP
KLLIFWASTRESGVPDRFTGSGSGTDFTLTISSVKAEDLAVYYCQQYYSY
PFTFGSGTKLEIKRGGGGSGGGGSGGGGSEVKLQQSGPVLVKPGASVKIS
CKASGYTFTDYYYMNWVKQSHGKSLEWIGYIYPNNSGTSYNQKFRGKATL
TVDKSSSTAYMEVRSLTSEDSAVYYCARYYDGFNAGFAYWGQGTLVTVSA.

In some embodiments, the anti-CD19 scFv comprises an amino acid sequence:

(SEQ ID NO: 271)
DIVLTQSTSSLAVSVGEKVTMSCKSSQSLLFGSNQKNYLAWYQQKLGQSP
KLLIFWASTRESGVPDRFTGSGSGTDFTLTISSVKAEDLAVYYCQQYYSY
PFTFGSGTKLEIKRGGGGSGGGGSGGGGSQVQLEESGPGLVAPSQSLSIT
CTVSGFSLSRYSVHWVRQPPGKGLEWLGMIWVNGNTDYNSALKSRLNINK
DNSKSQVFLKMNSLQTDDTAMYYCATYYGNYDSFTYWGQGTLVTVSA.

In some embodiments, the anti-CD19 scFv comprises an amino acid sequence:

(SEQ ID NO: 272)
DIVLTQSTSSLAVSVGEKVTMSCKSSQSLLFGSNQKNYLAWYQQKLGQSP
KLLIFWASTRESGVPDRFTGSGSGTDFTLTISSVKAEDLAVYYCQQYYSY
PFTFGSGTKLEIKRGGGGSGGGGSGGGGSEVQLQESGAELARPGASVKMS
CKASGYTFTSYWMHWVKQRPGQGLEWIGAIYPGNSDTSYNQKFKGKAKLT
AVTSASTAYMELSSLTNEDSAVYYCTTSLAYWGQGTLVTVSA.

In some embodiments, the anti-CD19 scFv comprises an amino acid sequence:

(SEQ ID NO: 273)
DIVLTQTNLTLSITIGQPASISCKSSQSLLDSDGKTYLNWLLQRPGQSPK
RLIYLVSKLDSGVPDRFTGSGSGTDFTLKISRVGAEDLGIYYCWQGTHFP
HTFGGGTKLEIKRGGGGSGGGGSGGGGSEVKLEESGGGLVKPGGSLKLSC
AASGFTFSSYAMSWVRQTPEKRLEWVASISSGGSTYYPDSVKGRFTISRD
NARNTLYLQMSSLRSEDTAMYYCARGRDGYSLYFDYWGQGTTLTVSS.

In some embodiments, the anti-CD19 scFv comprises an amino acid sequence:

(SEQ ID NO: 274)
DIVLTQTNLTLSITIGQPASISCKSSQSLLDSDGKTYLNWLLQRPGQSPK
RLIYLVSKLDSGVPDRFTGSGSGTDFTLKISRVGAEDLGIYYCWQGTHFP
HTFGGGTKLEIKRGGGGSGGGGSGGGGSQVKLQESGGGLVKPGGSLKLSC
AASGFTFSSYAMSWVRQTPEKRLEWVAGISSGGSFTYYPDTVKGRFTISR
DNARNTLYLQMSSLRSEDTAMYSCAREGVYSDYRAWFAYWGQGTLVTVS.

In some embodiments, the anti-CD19 scFv comprises an amino acid sequence:

(SEQ ID NO: 275)
DIVLTQTNLTLSITIGQPASISCKSSQSLLDSDGKTYLNWLLQRPGQSPK
RLIYLVSKLDSGVPDRFTGSGSGTDFTLKISRVGAEDLGIYYCWQGTHFP
HTFGGGTKLEIKRGGGSGGGGSGGGGSEVKLEQSGPSLVQPSQSLSITC
TVSGFSLTNFGVHWVRQSPGKGLEWLGLIWRGGSTDYNAAFMSRLSITKD
NSKSQVFFKMNSLQADDTAIYYCAKMGITYYFDYWGQGTTLTVSS.

In some embodiments, the anti-CD19 scFv comprises an amino acid sequence:

(SEQ ID NO: 276)
DIVLTQTNLTLSITIGQPASISCKSSQSLLDSDGKTYLNWLLQRPGQSPK
RLIYLVSKLDSGVPDRFTGSGSGTDFTLKISRVGAEDLGIYYCWQGTHFP
HTFGGGTKLEIKRGGGGSGGGGSGGGGSQVKLQSGDDLVKPGASVKLSC
KASGYTFTSYWINWIKQRPGQGLEWIGHIAPGTGSTYYSEMFKDKATLTV
DTPSSSAYIQLSSLSSEDSAVYFCAREGGRYYTLDCWGQGTSVTVSS.

In some embodiments, the anti-CD19 scFv comprises an amino acid sequence:

(SEQ ID NO: 277)
DIVLTQTNLTLSITIGQPASISCKSSQSLLDSDGKTYLNWLLQRPGQSPK
RLIYLVSKLDSGVPDRFTGSGSGTDFTLKISRVGAEDLGIYYCWQGTHFP
HTFGGGTKLEIKRGGGGSGGGGSGGGGSQVQLEESGPGLVKPSQTVSLTC
TVTGISITTGNYRWSWIRQFPGNKLEWIGYIYYSGTITYNPSLTSRTTIT
RDTSKNQFFLEMNSLTAEDTATYYCARWLNNFDVWGTGTTVTVS.

In some embodiments, the anti-CD19 scFv comprises an amino acid sequence:

(SEQ ID NO: 278)
DIVLTQTNLTLSITIGQPASISCKSSQSLLDSDGKTYLNWLLQRPGQSPK
RLIYLVSKLDSGVPDRFTGSGSGTDFTLKISRVGAEDLGIYYCWQGTHFP
HTFGGGTKLEIKRGGGGSGGGGSGGGGSEVMLVESGGGLVKPGGSLKLSC
AASGFTFSRYAMSWNRQTPEKRLEWVATISPGGGYIYYSDSVKGRFTISR
DNARNTLYLQMSSLRSEDTAMYYCAGDYVDYWGQGTTLTVSS.

In some embodiments, the anti-CD19 scFv comprises an amino acid sequence:

(SEQ ID NO: 279)
DIVLTQTNLTLSITIGQPASISCKSSQSLLDSDGKTYLNWLLQRPGQSPK
RLIYLVSKLDSGVPDRFTGSGSGTDFTLKISRVGAEDLGIYYCWQGTHFP
HTFGGGTKLEIKRGGGGSGGGGGGGSQVQLQESGPGLVKPSQSLSLTCT
VTGYSITSDYAWNWIRQFPGNKLEWMGYISYSGSTTYNPSLKGRISFTRD
TSKNQFFLHLKSVTTEDSATYYCARNWVYAMDYWGQGTSVTVSS.

In some embodiments, the anti-CD19 scFv comprises an amino acid sequence:

(SEQ ID NO: 280)
DIVLTQTNLTLSITIGQPASISCKSSQSLLDSDGKTYLNWLLQRPGQSPK
RLIYLVSKLDSGVPDRFTGSGSGTDFTLKISRVGAEDLGIYYCWQGTHFP
HTFGGGTKLEIKRGGGGSGGGGSGGGGSEVKLQQSGPVLVKPGASVKISC
KASGYTFTDYYYMNWVKQSHGKSLEWIGYIYPNNSGTSYNQKFRGKATLT
VDKSSSTAYMEVRSLTSEDSAVYYCARYYDGFNAGFAYWGQGTLVTVSA.

In some embodiments, the anti-CD19 scFv comprises an amino acid sequence:

(SEQ ID NO: 281)
DIVLTQTNLTLSITIGQPASISCKSSQSLLDSDGKTYLNWLLQRPGQSPK
RLIYLVSKLDSGVPDRFTGSGSGTDFTLKISRVGAEDLGIYYCWQGTHFP
HTFGGGTKLEIKRGGGGSGGGGSGGGGSQVQLEESGPGLVAPSQSLSITC
TVSGFSLSRYSVHWVRQPPGKGLEWLGMIWVNGNTDYNSALKSRLNINKD
NSKSQVFLKMNSLQTDDTAMYYCATYYGNYDSFTYWGQGTLVTVSA.

In some embodiments, the anti-CD19 scFv comprises an amino acid sequence:

(SEQ ID NO: 282)
DIVLTQTNLTLSITIGQPASISCKSSQSLLDSDGKTYLNWLLQRPGQSPK
RLIYLVSKLDSGVPDRFTGSGSGTDFTLKISRVGAEDLGIYYCWQGTHFP
HTFGGGTKLEIKRGGGGSGGGGSGGGGSEVQLQESGAELARPGASVKMSC
KASGYTFTSYWMHWVKQRPGQGLEWIGAIYPGNSDTSYNQKFKGKAKLTA
VTSASTAYMELSSLTNEDSAVYYCTTSLAYWGQGTLVTVSA.

In some embodiments, the anti-CD19 scFv comprises an amino acid sequence:

(SEQ ID NO: 283)
DIVLTQSPAIMSASPGEKVTMTCRASSSVSSSYLHWYQQKSGASPKLWIY
STSNLASGVPARFSGSGSGTSYSLTISSVEAEDAATYYCQQYSGYPLTFG
AGTKLELKRGGGGSGGGGSGGGGSEVKLEESGGGLVKPGGSLKLSCAASG
FTFSSYAMSWVRQTPEKRLEWVASISSGGSTYYPDSVKGRFTISRDNARN
TLYLQMSSLRSEDTAMYYCARGRDGYSLYFDYWGQGTTLVSS.

In some embodiments, the anti-CD19 scFv comprises an amino acid sequence:

(SEQ ID NO: 284)
DIVLTQSPAIMSASPGEKVTMTCRASSSVSSSYLHWYQQKSGASPKLWIY
STSNLASGVPARFSGSGSGTSYSLTISSVEAEDAATYYCQQYSGYPLTFG
AGTKLELKRGGGGSGGGGSGGGGSQVKLQESGGGLVKPGGSLKLSCAASG
FTFSSYAMSWVRQTPEKRLEWVAGISSGGSFTYYPDTVKGRFTISRDNAR
NTLYLQMSSLRSEDTAMYSCAREGVYSDYRAWFAYWGQGTLVTVS.

In some embodiments, the anti-CD19 scFv comprises an amino acid sequence:

(SEQ ID NO: 285)
DIVLTQSPAIMSASPGEKVTMTCRASSSVSSSYLHWYQQKSGASPKLWIY
STSNLASGVPARFSGSGSGTSYSLTISSVEAEDAATYYCQQYSGYPLTFG
AGTKLELKRGGGGSGGGGSGGGGSEVKLEQSGPSLVQPSQSLSITCTVSG
FSLTNFGVHWVRQSPGKGLEWLGLIWRGGSTDYNAAFMSRLSITKDNSKS
QVFFKMNSLQADDTAIYYCAKMGITYYFDYWGQGTTLVSS.

In some embodiments, the anti-CD19 scFv comprises an amino acid sequence:

(SEQ ID NO: 286)
DIVLTQSPAIMSASPGEKVTMTCRASSSVSSSYLHWYQQKSGASPKLWIY
STSNLASGVPARFSGSGSGTSYSLTISSVEAEDAATYYCQQYSGYPLTFG
AGTKLELKRGGGGSGGGGSGGGGSQVKLQQSGDDLVKPGASVKLSCKASG
YTFTSYWINWIKQRPGQGLEWIGHIAPGTGSTYYSEMFKDKATLTVDTPS
SSAYIQLSSLSSEDSAVYFCAREGGRYYTLDCWGQGTSVTVSS.

In some embodiments, the anti-CD19 scFv comprises an amino acid sequence:

(SEQ ID NO: 287)
DIVLTQSPAIMSASPGEKVTMTCRASSSVSSSYLHWYQQKSGASPKLWIY

STSNLASGVPARFSGSGSGTSYSLTISSVEAEDAATYYCQQYSGYPLTFG

AGTKLELKRGGGGSGGGGSGGGGSQVQLEESGPGLVKPSQTVSLTCTVTG

ISITTGNYRWSWIRQFPGNKLEWIGYIYYSGTITYNPSLTSRTTITRDTS

KNQFFLEMNSLTAEDTATYYCARWLNNFDVWGTGTTVTVS.

In some embodiments, the anti-CD19 scFv comprises an amino acid sequence:

(SEQ ID NO: 288)
DIVLTQSPAIMSASPGEKVTMTCRASSSVSSSYLHWYQQKSGASPKLWIY

STSNLASGVPARFSGSGSGTSYSLTISSVEAEDAATYYCQQYSGYPLTFG

AGTKLELKRGGGGSGGGGSGGGGSEVMLVESGGGLVKPGGSLKLSCAASG

FTFSRYAMSWNRQTPEKRLEWVATISPGGGYIYYSDSVKGRFTISRDNAR

NTLYLQMSSLRSEDTAMYYCAGDYVDYWGQGTTLTVSS.

In some embodiments, the anti-CD19 scFv comprises an amino acid sequence:

(SEQ ID NO: 289)
DIVLTQSPAIMSASPGEKVTMTCRASSSVSSSYLHWYQQKSGASPKLWIY

STSNLASGVPARFSGSGSGTSYSLTISSVEAEDAATYYCQQYSGYPLTFG

AGTKLELKRGGGGSGGGGSGGGGSQVQLQESGPGLVKPSQSLSLTCTVTG

YSITSDYAWNWIRQFPGNKLEWMGYISYSGSTTYNPSLKGRISFTRDTSK

NQFFLHLKSVTTEDSATYYCARNWVYAMDYWGQGTSVTVSS.

In some embodiments, the anti-CD19 scFv comprises an amino acid sequence:

(SEQ ID NO: 290)
DIVLTQSPAIMSASPGEKVTMTCRASSSVSSSYLHWYQQKSGASPKLWIY

STSNLASGVPARFSGSGSGTSYSLTISSVEAEDAATYYCQQYSGYPLTFG

AGTKLELKRGGGGSGGGGSGGGGSEVKLQQSGPVLVKPGASVKISCKASG

YTFTDYYYMNWVKQSHGKSLEWIGYIYPNNSGTSYNQKFRGKATLTVDKS

SSTAYMEVRSLTSEDSAVYYCARYYDGFNAGFAYWGQGTLVTVSA.

In some embodiments, the anti-CD19 scFv comprises an amino acid sequence:

(SEQ ID NO: 291)
DIVLTQSPAIMSASPGEKVTMTCRASSSVSSSYLHWYQQKSGASPKLWIY

STSNLASGVPARFSGSGSGTSYSLTISSVEAEDAATYYCQQYSGYPLTFG

AGTKLELKRGGGGSGGGGSGGGGSQVQLEESGPGLVAPSQSLSITCTVSG

FSLSRYSVHWVRQPPGKGLEWLGMIWVNGNTDYNSALKSRLNINKDNSKS

QVFLKMNSLQTDDTAMYYCATYYGNYDSFTYWGQGTLVTVSA.

In some embodiments, the anti-CD19 scFv comprises an amino acid sequence:

(SEQ ID NO: 292)
DIVLTQSPAIMSASPGEKVTMTCRASSSVSSSYLHWYQQKSGASPKLWIY

STSNLASGVPARFSGSGSGTSYSLTISSVEAEDAATYYCQQYSGYPLTFG

AGTKLELKRGGGGSGGGGSGGGGSEVQLQESGAELARPGASVKMSCKASG

YTFTSYWMHWVKQRPGQGLEWIGAIYPGNSDTSYNQKFKGKAKLTAVTSA

STAYMELSSLTNEDSAVYYCTTSLAYWGQGTLVTVSA.

In some embodiments, the anti-CD19 scFv binds to CD19 and comprises an amino acid sequence that is 95%, 96%, 97%, 98% or 99% identical to any of the specific anti-CD19 scFv amino acid sequences disclosed herein.

In some embodiments, the anti-CD19 scFv comprises an antigen binding domain of clone FMC63, described in Hohmann, A. W. Mol. Immunol. 34(16-17):1157-1165, which is incorporated by reference for the teaching of this antibody.

In some embodiments, the anti-CD19 scFv comprises an antigen binding domain of clone SJ25C1.

In some embodiments, the anti-CD19 scFv comprises the FVS191 or FVS192 scFv describe in Bejcek B E, et al. Cancer Res. 1995 55(11):2346-51, which is incorporated by reference for the teaching of this antibody.

Anti-CD20 scFv

In some embodiments, the anti-CD20 scFv is derived from hybridoma 1C3, 3C5, 8B7, 1A1, 18H11, 1B3, or combinations thereof. In some embodiments, the anti-CD20 scFv can comprise a variable heavy ($V_H$) domain having CDR1, CDR2 and CDR3 sequences and a variable light ($V_L$) domain having CDR1, CDR2 and CDR3 sequences.

In some embodiments, the anti-CD20 scFv can comprise a variable heavy ($V_H$) domain having CDR1, CDR2 and CDR3 sequences and a variable light ($V_L$) domain having CDR1, CDR2 and CDR3 sequences.

For example, in some embodiments, the CDR1 sequence of the $V_H$ domain comprises the amino acid sequence GYTFTDYE (SEQ ID NO:293), GFDFSRYW (SEQ ID NO:294), GFNIKDTY (SEQ ID NO:295), GYTFTSYG (SEQ ID NO:296), SFAMS (SEQ ID NO:297), or NYGMS (SEQ ID NO:298); CDR2 sequence of the $V_H$ domain comprises the amino acid sequence IDPETGDT (SEQ ID NO:299), INPDSSTI (SEQ ID NO:300), IDPANGNV (SEQ ID NO:301), IYPRSGNT (SEQ ID NO:302), TISSGGAYTFYKDSVKGRFT (SEQ ID NO:303), or SISSGDGRTYYSDNIRGRFT (SEQ ID NO:304); CDR3 sequence of the $V_H$ domain comprises the amino acid sequence TRANSFGY (SEQ ID NO:305), ARPGYYYAMDY (SEQ ID NO:306), DLSHYTMDY (SEQ ID NO:307), or ARSRV (SEQ ID NO:308), HSGYDGYYLYAMDY (SEQ ID NO:309), or RGDAMDY (SEQ ID NO:310); CDR1 sequence of the $V_L$ comprises the amino acid sequence TGAVTTSNY (SEQ ID NO:311), KSVSTSGYSY (SEQ ID NO:312), SSVSY (SEQ ID NO:313), RASQDISNYLN (SEQ ID NO:314), or SASSSVSYMH (SEQ ID NO:315); CDR2 sequence of the $V_L$ domain comprises the amino acid sequence GTN (SEQ ID to NO:316), LVS (SEQ ID NO:317), LTS (SEQ ID NO:318), YTSRLHS (SEQ ID NO:319), or EISKLAS (SEQ ID NO:320); and CDR3 sequence of the $V_L$ domain comprises the amino acid sequence ALWYNNHLV (SEQ ID NO:321), QHIRELT (SEQ ID NO:322), QQWSSNPFT (SEQ ID NO:323), QQGNTLPPT (SEQ ID NO:324), or QQWNYPLIT (SEQ ID NO:325).

Therefore, in some embodiments, the anti-CD20 scFv $V_H$ domain comprises the amino acid sequence: EVQLQES- GAELVKPGASVKLSC-
TASGFNIKDTYMHWVKQRPEQGLEWIGRIDPAN
GNVEYDPKFQGKATLTADTSSNTAYLQLSSLTSED-
TAVYYCDLSHYTMDYWGQGT SVTVSS (SEQ ID
NO:326, 8B7).

Therefore, in some embodiments, the anti-CD20 scFv $V_H$ domain is encoded by the nucleic acid sequence:

(SEQ ID NO: 337, 8B7)
GAGGTACAGCTGCAGGAGTCTGGGGCAGAACTTGTGAAGCCAGGGGCCTC

TGTCAAGTTGTCCTGCACAGCTTCTGGCTTCAACATTAAAGACACCTATA

TGCACTGGGTGAAACAGAGGCCTGAACAGGGCCTGGAGTGGATTGGAAGG

ATTGATCCTGCGAATGGTAATGTTGAATATGACCCGAAGTTCCAGGGCAA

GGCCACTCTAACAGCAGACACATCCTCCAATACAGCCTACCTGCAACTCA

GCAGCCTGACATCTGAGGACACTGCCGTCTATTACTGTGACCTATCCCAC

TATACTATGGACTACTGGGGTCAGGGAACCTCAGTCACCGTCTCCTCA.

Therefore, in some embodiments, the anti-CD20 scFv $V_H$ domain comprises the amino acid sequence:

(SEQ ID NO: 327, 1A1)
QVQLQQSGAELVRPGASVTLSCKASGYTFTDYEMHWVKQTPVHGLEWIGA

IDPETGDTAYNQKFKGKATLTADKSSSTAYMELSSLTSEDSAVYYCTRAN

SFGYWGQGTTLTVSS.

Therefore, in some embodiments, the anti-CD20 scFv $V_H$ domain is encoded (SEQ ID NO: 338, 1A1)
CAGGTTCAACTGCAGCAGTCTGGAGCTGAGCTGGTGAGGCCTGGGGCTTC

AGTGACGCTGTCCTGCAAGGCTTCGGGCTACACATTTACTGACTATGAAA

TGCACTGGGTGAAGCAGACACCTGTGCATGGCCTGGAATGGATTGGAGCT

ATTGATCCTGAAACTGGTGATACTGCCTACAATCAGAAGTTCAAGGGCAA

GGCCACACTGACTGCAGACAAATCCTCCAGCACAGCCTACATGGAGCTCA

GCAGCCTGACATCTGAGGACTCTGCCGTCTATTACTGTACAAGAGCTAAC

TCTTTTGGCTACTGGGGCCAAGGCACCACTCTCACAGTCTCCTCA.

Therefore, in some embodiments, the anti-CD20 scFv $V_H$ domain comprises the amino acid sequence:

(SEQ ID NO: 328, 18H11)
VQLQQSGAELARPGASVKLSCKASGYTFTSYGISWVKQRTGQGLEWIGEI

YPRSGNTYYNEKFKGKATLTADKSSSTAYMELRSLTSEDSAVYFCARSRV

WGTGTTVTVSS.

Therefore, in some embodiments, the anti-CD20 scFv $V_H$ domain is encoded by the nucleic acid sequence:

(SEQ ID NO: 339, 18H11)
GTTCAGCTGCAGCAGTCTGGAGCTGAGCTGGCGAGGCCTGGGGCTTCAGT

GAAGCTGTCCTGCAAGGCTTCTGGCTACACCTTCACAAGCTATGGTATAA

GCTGGGTGAAGCAGAGAACTGGACAGGGCCTTGAGTGGATTGGAGAGATT

TATCCTAGAAGTGGTAATACTTACTACAATGAGAAGTTCAAGGGCAAGGC

CACACTGACTGCAGACAAATCCTCCAGCACAGCGTACATGGAGCTCCGCA

GCCTGACATCTGAAGACTCTGCGGTCTATTTCTGTGCAAGATCCCGAGTC

TGGGGCACAGGGACCACGGTCACCGTCTCCTCA.

Therefore, in some embodiments, the anti-CD20 scFv $V_H$ domain comprises the amino acid sequence:

(SEQ ID NO: 329, 1B3)
DVKLQESGGGLVKPGGSLKLSCAVSGFTFSSFAMSWVRQTPEKRLEWVAT

ISSGGAYTFYKDSVKGRFTISRDNAKNTLYLQMSSLRSEDSAMYYCARHS

GYDGYYLYAMDYWGQGTSVTVSS.

Therefore, in some embodiments, the anti-CD20 scFv $V_H$ domain is encoded by the nucleic acid sequence:

(SEQ ID NO: 340, 1B3)
GATGTGAAGCTTCAGGAGTCTGGGGGAGGCTTAGTGAAGCCTGGAGGGTC

CCTGAAACTCTCCTGTGCAGTCTCTGGATTCACTTTCAGTTCCTTTGCCA

TGTCTTGGGTTCGCCAGACTCCGGAGAAGAGGCTGGAGTGGGTCGCAACC

ATTAGTAGTGGTGGAGCTTACACCTTCTATAAAGACAGTGTGAAGGGGCG

ATTCACCATCTCCAGAGACAATGCCAAGAATACCCTGTACCTGCAAATGA

GCAGTCTGAGGTCTGAGGACTCGGCCATGTATTACTGTGCAAGACATAGC

GGCTATGATGGTTACTACCTCTATGCTATGGACTACTGGGGTCAAGGAAC

CTCAGTCACCGTCTCCTCA.

Therefore, in some embodiments, the anti-CD20 scFv $V_H$ domain comprises the amino acid sequence:

(SEQ ID NO: 330, 1C3)
EVKLVESGGDLVKPGASLKLSCAASGFTFSNYGMSWIRQTSDKRLEWVAS

ISSGDGRTYYSDNIRGRFTISSENAKNTLYLQMSSLKSEDTALYYCTRGR

GLRGDAMDYWGQGTSVTVSS.

Therefore, in some embodiments, the anti-CD20 scFv $V_H$ domain is encoded by the nucleic acid sequence:

(SEQ ID NO: 341, 1C3)
GAAGTGAAGCTGGTGGAGTCTGGGGGAGACTTAGTGAAGCCTGGAGCGTC

TCTGAAACTCTCCTGTGCAGCCTCTGGGTTCACTTTCAGTAACTATGGCA

TGTCTTGGATTCGCCAGACTTCAGACAAGAGGCTGGAGTGGGTCGCATCC

ATTAGTAGTGGTGATGGTAGAACCTACTATTCAGACAATATAAGGGGCCG

ATTCACCATCTCCAGCGAGAATGCCAAGAACACCCTGTACCTGCAAATGA

GCAGTCTGAAGTCTGAGGACACGGCCTTGTATTACTGTACAAGAGGCCGG

GGATTACGGGGGGATGCTATGGACTACTGGGGTCAAGGAACCTCAGTCAC

CGTCTCCTCA.

Therefore, in some embodiments, the anti-CD20 scFv $V_H$ domain comprises the amino acid sequence:

(SEQ ID NO: 331, 3C5)
EVKLLESGGGLVQPGGSLKLSCAASGFDFSRYWMSWVRQAPGKGLEWIGE

INPDSSTINYTPSLKDKFIISRDNAKNTLYLQMSKVRSEDTALYYCARPG

YYYAMDYWGQGTSVTVSS.

Therefore, in some embodiments, the anti-CD20 scFv $V_H$ domain is encoded by the nucleic acid sequence:

(SEQ ID NO: 342, 3C5)
GAGGTGAAGCTTCTCGAGTCTGGAGGTGGCCTGGTGCAGCCTGGAGGATC

CCTGAAACTCTCCTGTGCAGCCTCAGGATTCGATTTTAGTAGATACTGGA

TGAGTTGGGTCCGGCAGGCTCCAGGGAAAGGGCTAGAATGGATTGGAGAA

ATTAATCCAGATAGCAGTACGATAAACTATACGCCATCTCTAAAGGATAA

ATTCATCATCTCCAGAGACAACGCCAAAAATACGCTGTACCTGCAAATGA

GCAAAGTGAGATCTGAGGACACAGCCCTTTATTACTGTGCAAGACCGGGT

TACTACTATGCTATGGACTACTGGGGTCAAGGAACCTCAGTCACCGTCTC

CTCA.

In some embodiments, the anti-CD20 scFv $V_L$ domain comprises the amino acid sequence:

(SEQ ID NO: 332, 8B7 & 1A1)
QAIVTQESALTTSPGETVTLTCRSSTGAVTTSNYATWVQEKPDHLFTGLM

GGTNIRAPGVPARFSGSLIGDKAALTITGAQTEDEAIYFCALWYNNHLVF

GGGTKLTV.

Therefore, in some embodiments, the anti-CD20 scFv $V_L$ domain is encoded by the nucleic acid sequence:

(SEQ ID NO: 343, 8B7 & 1A1)
CAGGCTATTGTGACTCAGGAATCTGCACTCACCACATCACCTGGTGAAAC

AGTCACACTCACTTGTCGCTCAAGCACTGGGGCTGTTACAACTAGTAATT

ATGCCACCTGGGTCCAAGAAAAACCAGATCATTTATTCACTGGTCTGATG

GGTGGCACCAACATCCGAGCTCCAGGTGTTCCTGCCAGATTCTCAGGCTC

CCTGATTGGAGACAAGGCTGCCCTCACCATCACAGGGGCACAGACTGAGG

ATGAGGCAATATATTTCTGTGCTCTATGGTACAACAACCATTTGGTGTTC

GGTGGAGGAACCAAACTGACTGTC.

In some embodiments, the anti-CD20 scFv $V_L$ domain comprises the amino acid sequence:

(SEQ ID NO: 333, 18H11)
QIVLTQSPALMSASPGEKVTMTCSASSSVSYMYWYQQKPRSSPKPWIYLT

SNLASGVPARFSGSGSGTSYSLTISSMEAEDAATYYCQQWSSNPFTGSG

TKLEIKR.

Therefore, in some embodiments, the anti-CD20 scFv $V_L$ domain is encoded by the nucleic acid sequence:

(SEQ ID NO: 344, 18H11)
CAAATTGTTCTCACCCAGTCTCCAGCACTCATGTCTGCATCTCCAGGGGA

GAAGGTCACCATGACCTGCAGTGCCAGCTCAAGTGTAAGTTACATGTACT

GGTACCAGCAGAAGCCAAGATCCTCCCCCAAACCCTGGATTTATCTCACA

TCCAACCTGGCTTCTGGAGTCCCTGCTCGCTTCAGTGGCAGTGGGTCTGG

GACCTCTTACTCTCTCACAATCAGCAGCATGGAGGCTGAAGATGCTGCCA

CTTATTACTGCCAGCAGTGGAGTAGTAACCCATTCACGTTCGGCTCGGGG

ACAAAGTTGGAAATAAAACGG.

Therefore, in some embodiments, the anti-CD20 scFv $V_L$ domain comprises the amino acid sequence:

(SEQ ID NO: 334, 1B3)
DIQMTQTTSSLSASLGDRVTISCRASQDISNYLNWYQQKPDGTVKLLIYY

TSRLHSGVPSRFSGSGSGTDYSLTISNLEQEDIATYFCQQGNTLPPTFGG

GTKLEIK.

Therefore, in some embodiments, the anti-CD20 scFv $V_L$ domain is encoded by the nucleic acid sequence:

(SEQ ID NO: 345, 1B3)
GATATCCAGATGACACAGACTACATCCTCCCTGTCTGCCTCTCTGGGAGA

CAGAGTCACCATCAGTTGCAGGGCAAGTCAGGACATTAGCAATTATTTAA

ACTGGTATCAGCAGAAACCAGATGGAACTGTTAAACTCCTGATCTACTAC

ACATCAAGATTACACTCAGGAGTCCCATCAAGGTTCAGTGGCAGTGGGTC

TGGAACAGATTATTCTCTCACCATTAGCAACCTGGAGCAAGAAGATATTG

CCACTTACTTTTGCCAACAGGGTAATACGCTTCCTCCGACGTTCGGTGGA

GGCACCAAGCTGGAAATCAAA.

Therefore, in some embodiments, the anti-CD20 scFv $V_L$ domain comprises the amino acid sequence:

(SEQ ID NO: 335, 1C3)
EIVLTQSPAITAASLGQKVTITCSASSSVSYMHWYQQKSGTSPKPWIYEI

SKLASGVPARFSGSGSGTSYSLTISSMEAEDAAIYYCQQWNYPLITFGGG

TKLEI.

Therefore, in some embodiments, the anti-CD20 scFv $V_L$ domain is encoded by the nucleic acid sequence:

(SEQ ID NO: 346, 1C3)
GAAATTGTGCTCACTCAGTCTCCAGCCATCACAGCTGCATCTCTGGGGCA

AAAGGTCACCATCACCTGCAGTGCCAGCTCAAGTGTAAGTTACATGCACT

GGTACCAGCAGAAGTCAGGCACCTCCCCCAAACCATGGATTTATGAAATA

TCCAAACTGGCTTCTGGAGTCCCAGCTCGCTTCAGTGGCAGTGGGTCTGG

GACCTCTTACTCTCTCACAATCAGCAGCATGGAGGCTGAAGATGCTGCCA

TTTATTACTGCCAGCAGTGGAATTATCCTCTTATCACGTTCGGAGGGGGG

ACCAAGCTGGAAATA.

Therefore, in some embodiments, the anti-CD20 scFv V$_L$ domain comprises the amino acid sequence:

(SEQ ID NO: 336, 3C5)
DIVLTQSPASLAVSLGQRATISYRASKSVSTSGYSYMHWNQQKPGQPPRL

LIYLVSNLESGVPARFSGSGSGTDFTLNIHPVEEEDAATYYCQHIRELTR

SEGGPSWK.

Therefore, in some embodiments, the anti-CD20 scFv V$_L$ domain is encoded by the nucleic acid sequence:

(SEQ ID NO: 347, 3C5)
GACATTGTGCTGACACAGTCTCCTGCTTCCTTAGCTGTATCTCTGGGGCA

GAGGGCCACCATCTCATACAGGGCCAGCAAAAGTGTCAGTACATCTGGCT

ATAGTTATATGCACTGGAACCAACAGAAACCAGGACAGCCACCCAGACTC

CTCATCTATCTTGTATCCAACCTAGAATCTGGGGTCCCTGCCAGGTTCAG

TGGCAGTGGGTCTGGGACAGACTTCACCCTCAACATCCATCCTGTGGAGG

AGGAGGATGCTGCAACCTATTACTGTCAGCACATTAGGGAGCTTACACGT

TCGGAGGGGGGACCAAGCTGGAAATAA.

In some embodiments, the anti-CD20 scFv comprises an amino acid sequence:

(SEQ ID NO: 348)
EVQLQESGAELVKPGASVKLSCTASGFNIKDTYMHWVKQRPEQGLEWIGR

IDPANGNVEYDPKFQGKATLTADTSSNTAYLQLSSLTSEDTAVYYCDLSH

YTMDYWGQGTSVTVSSGGGGSGGGGSGGGGSQAIVTQESALTTSPGETVT

LTCRSSTGAVTTSNYATWVQEKPDHLFTGLMGGTNIRAPGVPARFSGSLI

GDKAALTITGAQTEDEAIYFCALWYNNHLVFGGGTKLTV.

In some embodiments, the anti-CD20 scFv comprises an amino acid sequence:

(SEQ ID NO: 349)
EVQLQESGAELVKPGASVKLSCTASGFNIKDTYMHWVKQRPEQGLEWIGR

IDPANGNVEYDPKFQGKATLTADTSSNTAYLQLSSLTSEDTAVYYCDLSH

YTMDYWGQGTSVTVSSGGGGSGGGGSGGGGSQIVLTQSPALMSASPGEKV

TMTCSASSSVSYMYWYQQKPRSSPKPWIYLTSNLASGVPARFSGSGSGTS

YSLTISSMEAEDAATYYCQQWSSNPFTFGSGTKLEIKR.

In some embodiments, the anti-CD20 scFv comprises an amino acid sequence:

(SEQ ID NO: 350)
EVQLQESGAELVKPGASVKLSCTASGFNIKDTYMHWVKQRPEQGLEWIGR

IDPANGNVEYDPKFQGKATLTADTSSNTAYLQLSSLTSEDTAVYYCDLSH

YTMDYWGQGTSVTVSSGGGGSGGGGSGGGGSDIQMTQTTSSLSASLGDRV

TISCRASQDISNYLNWYQQKPDGTVKLLIYYTSRLHSGVPSRFSGSGSGT

DYSLTISNLEQEDIATYFCQQGNTLPPTFGGGTKLEIK.

In some embodiments, the anti-CD20 scFv comprises an amino acid sequence:

(SEQ ID NO: 351)
EVQLQESGAELVKPGASVKLSCTASGFNIKDTYMHWVKQRPEQGLEWIGR

IDPANGNVEYDPKFQGKATLTADTSSNTAYLQLSSLTSEDTAVYYCDLSH

YTMDYWGQGTSVTVSSGGGGSGGGGSGGGGSEIVLTQSPAITAASLGQKV

TITCSASSSVSYMHWYQQKSGTSPKPWIYEISKLASGVPARFSGSGSGTS

YSLTISSMEAEDAAIYYCQQWNYPLITFGGGTKLEI.

In some embodiments, the anti-CD20 scFv comprises an amino acid sequence:

(SEQ ID NO: 352)
EVQLQESGAELVKPGASVKLSCTASGFNIKDTYMHWVKQRPEQGLEWIGR

IDPANGNVEYDPKFQGKATLTADTSSNTAYLQLSSLTSEDTAVYYCDLSH

YTMDYWGQGTSVTVSSGGGGSGGGGSGGGGSDIVLTQSPASLAVSLGQRA

TISYRASKSVSTSGYSYMHWNQQKPGQPPRLLIYLVSNLESGVPARFSGS

GSGTDFTLNIHPVEEEDAATYYCQHIRELTRSEGGPSWK.

In some embodiments, the anti-CD20 scFv comprises an amino acid sequence:

(SEQ ID NO: 353)
QVQLQQSGAELVRPGASVTLSCKASGYTFTDYEMHWVKQTPVHGLEWIGA

IDPETGDTAYNQKFKGKATLTADKSSSTAYMELSSLTSEDSAVYYCTRAN

SFGYWGQGTTLTVSSGGGGSGGGGSGGGGSQAIVTQESALTTSPGETVTL

TCRSSTGAVTTSNYATWVQEKPDHLFTGLMGGTNIRAPGVPARFSGSLIG

DKAALTITGAQTEDEAIYFCALWYNNHLVFGGGTKLTV.

In some embodiments, the anti-CD20 scFv comprises an amino acid sequence:

(SEQ ID NO: 354)
QVQLQQSGAELVRPGASVTLSCKASGYTFTDYEMHWVKQTPVHGLEWIGA

IDPETGDTAYNQKFKGKATLTADKSSSTAYMELSSLTSEDSAVYYCTRAN

SFGYWGQGTTLTVSSGGGGSGGGGSGGGGSQIVLTQSPALMSASPGEKVT

MTCSASSSVSYMYWYQQKPRSSPKPWIYLTSNLASGVPARFSGSGSGTSY

SLTISSMEAEDAATYYCQQWSSNPFTFGSGTKLEIKR.

In some embodiments, the anti-CD20 scFv comprises an amino acid sequence:

(SEQ ID NO: 355)
QVQLQQSGAELVRPGASVTLSCKASGYTFTDYEMHWVKQTPVHGLEWIGA

IDPETGDTAYNQKFKGKATLTADKSSSTAYMELSSLTSEDSAVYYCTRAN

SFGYWGQGTTLTVSSGGGGSGGGGSGGGGSDIQMTQTTSSLSASLGDRVT

ISCRASQDISNYLNWYQQKPDGTVKLLIYYTSRLHSGVPSRFSGSGSGTD

YSLTISNLEQEDIATYFCQQGNTLPPTFGGGTKLEIK.

In some embodiments, the anti-CD20 scFv comprises an amino acid sequence:

(SEQ ID NO: 356)
QVQLQQSGAELVRPGASVTLSCKASGYTFTDYEMHWVKQTPVHGLEWIGA
IDPETGDTAYNQKFKGKATLTADKSSSTAYMELSSLTSEDSAVYYCTRAN
SFGYWGQGTTLTVSSGGGGSGGGGSGGGGSEIVLTQSPAITAASLGQKVT
ITCSASSSVSYMHWYQQKSGTSPKPWIYEISKLASGVPARFSGSGSGTSY
SLTISSMEAEDAAIYYCQQWNYPLITFGGGTKLEI.

In some embodiments, the anti-CD20 scFv comprises an amino acid sequence:

(SEQ ID NO: 357)
QVQLQQSGAELVRPGASVTLSCKASGYTFTDYEMHWVKQTPVHGLEWIGA
IDPETGDTAYNQKFKGKATLTADKSSSTAYMELSSLTSEDSAVYYCTRAN
SFGYWGQGTTLTVSSGGGGSGGGGSGGGGSDIVLTQSPASLAVSLGQRAT
ISYRASKSVSTGYSYMHWNQQKPGQPPRLLIYLVSNLESGVPARFSGSG
SGTDFTLNIHPVEEEDAATYYCQHIRELTRSEGGPSWK.

In some embodiments, the anti-CD20 scFv comprises an amino acid sequence:

(SEQ ID NO: 358)
VQLQQSGAELARPGASVKLSCKASGYTFTSYGISWVKQRTGQGLEWIGE
IYPRSGNTYYNEKFKGKATLTADKSSSTAYMELRSLTSEDSAVYFCARS
RVWGTGTTVTVSSGGGGSGGGGSGGGGSQAIVTQESALTTSPGETVTLT
CRSSTGAVTTSNYATWVQEKPDHLFTGLMGGTNIRAPGVPARFSGSLIG
DKAALTITGAQTEDEAIYFCALWYNNHLVFGGGTKLTV.

In some embodiments, the anti-CD20 scFv comprises an amino acid sequence:

(SEQ ID NO: 359)
VQLQQSGAELARPGASVKLSCKASGYTFTSYGISWVKQRTGQGLEWIGE
IYPRSGNTYYNEKFKGKATLTADKSSSTAYMELRSLTSEDSAVYFCARS
RVWGTGTTVTVSSGGGGSGGGGSGGGGSQIVLTQSPALMSASPGEKVTM
TCSASSSVSYMYWYQQKPRSSPKPWIYLTSNLASGVPARFSGSGSGTSY
SLTISSMEAEDAATYYCQQWSSNPFTFGSGTKLEIKR.

In some embodiments, the anti-CD20 scFv comprises an amino acid sequence:

(SEQ ID NO: 360)
VQLQQSGAELARPGASVKLSCKASGYTFTSYGISWVKQRTGQGLEWIGE
IYPRSGNTYYNEKFKGKATLTADKSSSTAYMELRSLTSEDSAVYFCARS
RVWGTGTTVTVSSGGGGSGGGGSGGGGSDIQMTQTTSSLSASLGDRVTI
SCRASQDISNYLNWYQQKPDGTVKLLIYYTSRLHSGVPSRFSGSGSGTD
YSLTISNLEQEDIATYFCQQGNTLPPTFGGGTKLEIK.

In some embodiments, the anti-CD20 scFv comprises an amino acid sequence:

(SEQ ID NO: 361)
VQLQQSGAELARPGASVKLSCKASGYTFTSYGISWVKQRTGQGLEWIGE
IYPRSGNTYYNEKFKGKATLTADKSSSTAYMELRSLTSEDSAVYFCARS
RVWGTGTTVTVSSGGGGSGGGGSGGGGSEIVLTQSPAITAASLGQKVTI
TCSASSSVSYMHWYQQKSGTSPKPWIYEISKLASGVPARFSGSGSGTSY
SLTISSMEAEDAAIYYCQQWNYPLITFGGGTKLEI.

In some embodiments, the anti-CD20 scFv comprises an amino acid sequence:

(SEQ ID NO: 362)
VQLQQSGAELARPGASVKLSCKASGYTFTSYGISWVKQRTGQGLEWIGE
IYPRSGNTYYNEKFKGKATLTADKSSSTAYMELRSLTSEDSAVYFCARS
RVWGTGTTVTVSSGGGGSGGGGSGGGGSDIVLTQSPASLAVSLGQRATI
SYRASKSVSTGYSYMHWNQQKPGQPPRLLIYLVSNLESGVPARFSGSG
SGTDFTLNIHPVEEEDAATYYCQHIRELTRSEGGPSWK.

In some embodiments, the anti-CD20 scFv comprises an amino acid sequence:

(SEQ ID NO: 363)
DVKLQESGGGLVKPGGSLKLSCAVSGFTFSSFAMSWVRQTPEKRLEWVA
TISSGGAYTFYKDSVKGRFTISRDNAKNTLYLQMSSLRSEDSAMYYCAR
HSGYDGYYLYAMDYWGQGTSVTVSSGGGGSGGGGSGGGGSQAIVTQESA
LTTSPGETVTLTCRSSTGAVTTSNYATWVQEKPDHLFTGLMGGTNIRAP
GVPARFSGSLIGDKAALTITGAQTEDEAIYFCALWYNNHLVFGGGTKLT
V.

In some embodiments, the anti-CD20 scFv comprises an amino acid sequence:

(SEQ ID NO: 364)
DVKLQESGGGLVKPGGSLKLSCAVSGFTFSSFAMSWVRQTPEKRLEWVA
TISSGGAYTFYKDSVKGRFTISRDNAKNTLYLQMSSLRSEDSAMYYCAR
HSGYDGYYLYAMDYWGQGTSVTVSSGGGGSGGGGSGGGGSQIVLTQSPA
LMSASPGEKVTMTCSASSSVSYMYWYQQKPRSSPKPWIYLTSNLASGVP
ARFSGSGSGTSYSLTISSMEAEDAATYYCQQWSSNPFTFGSGTKLEIKR.

In some embodiments, the anti-CD20 scFv comprises an amino acid sequence:

(SEQ ID NO: 365)
DVKLQESGGGLVKPGGSLKLSCAVSGFTFSSFAMSWVRQTPEKRLEWVA
TISSGGAYTFYKDSVKGRFTISRDNAKNTLYLQMSSLRSEDSAMYYCAR
HSGYDGYYLYAMDYWGQGTSVTVSSGGGGSGGGGSGGGGSDIQMTQTTS
SLSASLGDRVTISCRASQDISNYLNWYQQKPDGTVKLLIYYTSRLHSGV
PSRFSGSGSGTDYSLTISNLEQEDIATYFCQQGNTLPPTFGGGTKLEIK.

In some embodiments, the anti-CD20 scFv comprises an amino acid sequence:

(SEQ ID NO: 366)
DVKLQESGGGLVKPGGSLKLSCAVSGFTFSSFAMSWVRQTPEKRLEWVA
TISSGGAYTFYKDSVKGRFTISRDNAKNTLYLQMSSLRSEDSAMYYCAR
HSGYDGYYLYAMDYWGQGTSVTVSSGGGGSGGGGSGGGGSEIVLTQSPA
ITAASLGQKVTITCSASSSVSYMHWYQQKSGTSPKPWIYEISKLASGVP
ARFSGSGSGTSYSLTISSMEAEDAAIYYCQQWNYPLITFGGGTKLEI.

In some embodiments, the anti-CD20 scFv comprises an amino acid sequence:

(SEQ ID NO: 367)
DVKLQESGGGLVKPGGSLKLSCAVSGFTFSSFAMSWVRQTPEKRLEWVA
TISSGGAYTFYKDSVKGRFTISRDNAKNTLYLQMSSLRSEDSAMYYCAR
HSGYDGYYLYAMDYWGQGTSVTVSSGGGGSGGGGSGGGGSDIVLTQSPA
SLAVSLGQRATISYRASKSVSTSGYSYMHWNQQKPGQPPRLLIYLVSNL
ESGVPARFSGSGSGTDFTLNIHPVEEEDAATYYCQHIRELTRSEGGPSW
K.

In some embodiments, the anti-CD20 scFv comprises an amino acid sequence:

(SEQ ID NO: 368)
EVKLVESGGDLVKPGASLKLSCAASGFTFSNYGMSWIRQTSDKRLEWVA
SISSGDGRTYYSDNIRGRFTISSENAKNTLYLQMSSLKSEDTALYYCTR
GRGLRGDAMDYWGQGTSVTVSSGGGGSGGGGGGGGSQAIVTQESALTTS
PGETVTLTCRSSTGAVTTSNYATWVQEKPDHLFTGLMGGTNIRAPGVPA
RFSGSLIGDKAALTITGAQTEDEAIYFCALWYNNHLVFGGGTKLTV.

In some embodiments, the anti-CD20 scFv comprises an amino acid sequence:

(SEQ ID NO: 369)
EVKLVESGGDLVKPGASLKLSCAASGFTFSNYGMSWIRQTSDKRLEWVA
SISSGDGRTYYSDNIRGRFTISSENAKNTLYLQMSSLKSEDTALYYCTR
GRGLRGDAMDYWGQGTSVTVSSGGGGSGGGGSGGGGSQIVLTQSPALMS
ASPGEKVTMTCSASSSVSYMYWYQQKPRSSPKPWIYLTSNLASGVPARF
SGSGSGTSYSLTISSMEAEDAATYYCQQWSSNPFTFGSGTKLEIKR.

In some embodiments, the anti-CD20 scFv comprises an amino acid sequence:

(SEQ ID NO: 370)
EVKLVESGGDLVKPGASLKLSCAASGFTFSNYGMSWIRQTSDKRLEWVA
SISSGDGRTYYSDNIRGRFTISSENAKNTLYLQMSSLKSEDTALYYCTR
GRGLRGDAMDYWGQGTSVTVSSGGGGSGGGGSGGGGSDIQMTQTTSSLS
ASLGDRVTISCRASQDISNYLNWYQQKPDGTVKLLIYYTSRLHSGVPSR
FSGSGSGTDYSLTISNLEQEDIATYFCQQGNTLPPTFGGGTKLEIK.

In some embodiments, the anti-CD20 scFv comprises an amino acid sequence:

(SEQ ID NO: 371)
EVKLVESGGDLVKPGASLKLSCAASGFTFSNYGMSWIRQTSDKRLEWVA
SISSGDGRTYYSDNIRGRFTISSENAKNTLYLQMSSLKSEDTALYYCTR
GRGLRGDAMDYWGQGTSVTVSSGGGGSGGGGSGGGGSEIVLTQSPAITA
ASLGQKVTITCSASSSVSYMHWYQQKSGTSPKPWIYEISKLASGVPARF
SGSGSGTSYSLTISSMEAEDAAIYYCQQWNYPLITFGGGTKLEI.

In some embodiments, the anti-CD20 scFv comprises an amino acid sequence:

(SEQ ID NO: 372)
EVKLVESGGDLVKPGASLKLSCAASGFTFSNYGMSWIRQTSDKRLEWVA
SISSGDGRTYYSDNIRGRFTISSENAKNTLYLQMSSLKSEDTALYYCTR
GRGLRGDAMDYWGQGTSVTVSSGGGGSGGGGSGGGGSDIVLTQSPASLA
VSLGQRATISYRASKSVSTSGYSYMHWNQQKPGQPPRLLIYLVSNLESG
VPARFSGSGSGTDFTLNIHPVEEEDAATYYCQHIRELTRSEGGPSWK.

In some embodiments, the anti-CD20 scFv comprises an amino acid sequence:

(SEQ ID NO: 373)
EVKLLESGGGLVQPGGSLKLSCAASGFDFSRYWMSWVRQAPGKGLEWIGE
INPDSSTINYTPSLKDKFIISRDNAKNTLYLQMSKVRSEDTALYYCARPG
YYYAMDYWGQGTSVTVSSGGGGSGGGGSGGGGSQAIVTQESALTTSPGET
VTLTCRSSTGAVTTSNYATWVQEKPDHLFTGLMGGTNIRAPGVPARFSGS
LIGDKAALTITGAQTEDEAIYFCALWYNNHLVFGGGTKLTV.

In some embodiments, the anti-CD20 scFv comprises an amino acid sequence:

(SEQ ID NO: 374)
EVKLLESGGGLVQPGGSLKLSCAASGFDFSRYWMSWVRQAPGKGLEWIGE
INPDSSTINYTPSLKDKFIISRDNAKNTLYLQMSKVRSEDTALYYCARPG
YYYAMDYWGQGTSVTVSSGGGGGGGGSGGGGSQIVLTQSPALMSASPGEK
VTMTCSASSSVSYMYWYQQKPRSSPKPWIYLTSNLASGVPARFSGSGSGT
SYSLTISSMEAEDAATYYCQQWSSNPFTFGSGTKLEIKR.

In some embodiments, the anti-CD20 scFv comprises an amino acid sequence:

(SEQ ID NO: 375)
EVKLLESGGGLVQPGGSLKLSCAASGFDFSRYWMSWVRQAPGKGLEWIGE
INPDSSTINYTPSLKDKFIISRDNAKNTLYLQMSKVRSEDTALYYCARPG
YYYAMDYWGQGTSVTVSSGGGGSGGGGSGGGGSDIQMTQTTSSLSASLGD
RVTISCRASQDISNYLNWYQQKPDGTVKLLIYYTSRLHSGVPSRFSGSGS
GTDYSLTISNLEQEDIATYFCQQGNTLPPTFGGGTKLEIK.

In some embodiments, the anti-CD20 scFv comprises an amino acid sequence:

(SEQ ID NO: 376)
EVKLLESGGGLVQPGGSLKLSCAASGFDFSRYWMSWVRQAPGKGLEWIGE
INPDSSTINYTPSLKDKFIISRDNAKNTLYLQMSKVRSEDTALYYCARPG
YYYAMDYWGQGTSVTVSSGGGGSGGGGSGGGGSEIVLTQSPAITAASLGQ
KVTITCSASSSVSYMHWYQQKSGTSPKPWIYEISKLASGVPARFSGSGSG
TSYSLTISSMEAEDAAIYYCQQWNYPLITFGGGTKLEI.

In some embodiments, the anti-CD20 scFv comprises an amino acid sequence:

(SEQ ID NO: 377)
EVKLLESGGGLVQPGGSLKLSCAASGFDFSRYWMSWVRQAPGKGLEWIGE
INPDSSTINYTPSLKDKFIISRDNAKNTLYLQMSKVRSEDTALYYCARPG
YYYAMDYWGQGTSVTVSSGGGGSGGGGSGGGGSDIVLTQSPASLAVSLGQ
RATISYRASKSVSTSGYSYMHWNQQKPGQPPRLLIYLVSNLESGVPARFS
GSGSGTDFTLNIHPVEEEDAATYYCQHIRELTRSEGGPSWK.

In some embodiments, the anti-CD20 scFv comprises an amino acid sequence:

(SEQ ID NO: 378)
QAIVTQESALTTSPGETVTLTCRSSTGAVTTSNYATWVQEKPDHLFTGLM
GGTNIRAPGVPARFSGSLIGDKAALTITGAQTEDEAIYFCALWYNNHLVF
GGGTKLTVGGGGSGGGGSGGGGSEVQLQESGAELVKPGASVKLSCTASGF
NIKDTYMHWVKQRPEQGLEWIGRIDPANGNVEYDPKFQGKATLTADTSSN
TAYLQLSSLTSEDTAVYYCDLSHYTMDYWGQGTSVTVSS.

In some embodiments, the anti-CD20 scFv comprises an amino acid sequence:

(SEQ ID NO: 379)
QAIVTQESALTTSPGETVTLTCRSSTGAVTTSNYATWVQEKPDHLFTGLM
GGTNIRAPGVPARFSGSLIGDKAALTITGAQTEDEAIYFCALWYNNHLVF
GGGTKLTVGGGGSGGGGSGGGGSQVQLQQSGAELVRPGASVTLSCKASGY
TFTDYEMHWVKQTPVHGLEWIGAIDPETGDTAYNQKFKGKATLTADKSSS
TAYMELSSLTSEDSAVYYCTRANSFGYWGQGTTLTVSS.

In some embodiments, the anti-CD20 scFv comprises an amino acid sequence:

(SEQ ID NO: 380)
QAIVTQESALTTSPGETVTLTCRSSTGAVTTSNYATWVQEKPDHLFTGLM
GGTNIRAPGVPARFSGSLIGDKAALTITGAQTEDEAIYFCALWYNNHLVF
GGGTKLTVGGGGSGGGGSGGGGSVQLQQSGAELARPGASVKLSCKASGYT
FTSYGISWVKQRTGQGLEWIGEIYPRSGNTYYNEKFKGKATLTADKSSST
AYMELRSLTSEDSAVYFCARSRVWGTGTTVTVSS.

In some embodiments, the anti-CD20 scFv comprises an amino acid sequence:

(SEQ ID NO: 381)
QAIVTQESALTTSPGETVTLTCRSSTGAVTTSNYATWVQEKPDHLFTGLM
GGTNIRAPGVPARFSGSLIGDKAALTITGAQTEDEAIYFCALWYNNHLVF
GGGTKLTVGGGGSGGGGSGGGGSDVKLQESGGGLVKPGGSLKLSCAVSGF
TFSSFAMSWVRQTPEKRLEWVATISSGGAYTFYKDSVKGRFTISRDNAKN
TLYLQMSSLRSEDSAMYYCARHSGYDGYYLYAMDYWGQGTSVTVSS.

In some embodiments, the anti-CD20 scFv comprises an amino acid sequence:

(SEQ ID NO: 382)
QAIVTQESALTTSPGETVTLTCRSSTGAVTTSNYATWVQEKPDHLFTGLM
GGTNIRAPGVPARFSGSLIGDKAALTITGAQTEDEAIYFCALWYNNHLVF
GGGTKLTVGGGGSGGGGSGGGGSEVKLVESGGDLVKPGASLKLSCAASGF
TFSNYGMSWIRQTSDKRLEWVASISSGDGRTYYSDNIRGRFTISSENAKN
TLYLQMSSLKSEDTALYYCTRGRGLRGDAMDYWGQGTSVTVSS.

In some embodiments, the anti-CD20 scFv comprises an amino acid sequence:

(SEQ ID NO: 383)
QAIVTQESALTTSPGETVTLTCRSSTGAVTTSNYATWVQEKPDHLFTGLM
GGTNIRAPGVPARFSGSLIGDKAALTITGAQTEDEAIYFCALWYNNHLVF
GGGTKLTVGGGGSGGGGSGGGGSEVKLLESGGGLVQPGGSLKLSCAASGF
DFSRYWMSWVRQAPGKGLEWIGEINPDSSTINYTPSLKDKFIISRDNAKN
TLYLQMSKVRSEDTALYYCARPGYYYAMDYWGQGTSVTVSS.

In some embodiments, the anti-CD20 scFv comprises an amino acid sequence:

(SEQ ID NO: 384)
QIVLTQSPALMSASPGEKVTMTCSASSSVSYMYWYQQKPRSSPKPWIYLT
SNLASGVPARFSGSGSGTSYSLTISSMEAEDAATYYCQQWSSNPFTFGSG
TKLEIKRGGGGSGGGGSGGGGSEVQLQESGAELVKPGASVKLSCTASGFN
IKDTYMHWVKQRPEQGLEWIGRIDPANGNVEYDPKFQGKATLTADTSSNT
AYLQLSSLTSEDTAVYYCDLSHYTMDYWGQGTSVTVSS.

In some embodiments, the anti-CD20 scFv comprises an amino acid sequence:

(SEQ ID NO: 385)
QIVLTQSPALMSASPGEKVTMTCSASSSVSYMYWYQQKPRSSPKPWIYLT
SNLASGVPARFSGSGSGTSYSLTISSMEAEDAATYYCQQWSSNPFTFGSG
TKLEIKRGGGGSGGGGSGGGGSQVQLQQSGAELVRPGASVTLSCKASGYT
FTDYEMHWVKQTPVHGLEWIGAIDPETGDTAYNQKFKGKATLTADKSSST
AYMELSSLTSEDSAVYYCTRANSFGYWGQGTTLTVSS.

In some embodiments, the anti-CD20 scFv comprises an amino acid sequence:

(SEQ ID NO: 386)
QIVLTQSPALMSASPGEKVTMTCSASSSVSYMYWYQQKPRSSPKPWIYLT
SNLASGVPARFSGSGSGTSYSLTISSMEAEDAATYYCQQWSSNPFTFGSG
TKLEIKRGGGGSGGGGSGGGGSVQLQQSGAELARPGASVKLSCKASGYTF
TSYGISWVKQRTGQGLEWIGEIYPRSGNTYYNEKFKGKATLTADKSSSTA
YMELRSLTSEDSAVYFCARSRVWGTGTTVTVSS.

In some embodiments, the anti-CD20 scFv comprises an amino acid sequence:

(SEQ ID NO: 387)
QIVLTQSPALMSASPGEKVTMTCSASSSVSYMYWYQQKPRSSPKPWIYLT
SNLASGVPARFSGSGSGTSYSLTISSMEAEDAATYYCQQWSSNPFTFGSG
TKLEIKRGGGGSGGGGSGGGGSDVKLQESGGGLVKPGGSLKLSCAVSGFT
FSSFAMSWVRQTPEKRLEWVATISSGGAYTFYKDSVKGRFTISRDNAKNT
LYLQMSSLRSEDSAMYYCARHSGYDGYYLYAMDYWGQGTSVTVSS.

In some embodiments, the anti-CD20 scFv comprises an amino acid sequence:

(SEQ ID NO: 388)
QIVLTQSPALMSASPGEKVTMTCSASSSVSYMYWYQQKPRSSPKPWIYLT
SNLASGVPARFSGSGSGTSYSLTISSMEAEDAATYYCQQWSSNPFTFGSG
TKLEIKRGGGGSGGGGSGGGGSEVKLVESGGDLVKPGASLKLSCAASGFT
FSNYGMSWIRQTSDKRLEWVASISSGDGRTYYSDNIRGRFTISSENAKNT
LYLQMSSLKSEDTALYYCTRGRGLRGDAMDYWGQGTSVTVSS.

In some embodiments, the anti-CD20 scFv comprises an amino acid sequence:

(SEQ ID NO: 389)
QIVLTQSPALMSASPGEKVTMTCSASSSVSYMYWYQQKPRSSPKPWIYLT
SNLASGVPARFSGSGSGTSYSLTISSMEAEDAATYYCQQWSSNPFTFGSG
TKLEIKRGGGGSGGGGSGGGGSEVKLLESGGGLVQPGGSLKLSCAASGFD
FSRYWMSWVRQAPGKGLEWIGEINPDSSTINYTPSLKDKFIISRDNAKNT
LYLQMSKVRSEDTALYYCARPGYYYAMDYWGQGTSVTVSS.

In some embodiments, the anti-CD20 scFv comprises an amino acid sequence:

(SEQ ID NO: 390)
DIQMTQTTSSLSASLGDRVTISCRASQDISNYLNWYQQKPDGTVKLLIYY
TSRLHSGVPSRFSGSGSGTDYSLTISNLEQEDIATYFCQQGNTLPPTFGG
GTKLEIKGGGGSGGGGSGGGGSEVQLQESGAELVKPGASVKLSCTASGFN
IKDTYMHWVKQRPEQGLEWIGRIDPANGNVEYDPKFQGKATLTADTSSNT
AYLQLSSLTSEDTAVYYCDLSHYTMDYWGQGTSVTVSS.

In some embodiments, the anti-CD20 scFv comprises an amino acid sequence:

(SEQ ID NO: 391)
DIQMTQTTSSLSASLGDRVTISCRASQDISNYLNWYQQKPDGTVKLLIYY
TSRLHSGVPSRFSGSGSGTDYSLTISNLEQEDIATYFCQQGNTLPPTFGG
GTKLEIKGGGGSGGGGSGGGGSQVQLQQSGAELVRPGASVTLSCKASGYT
FTDYEMHWVKQTPVHGLEWIGAIDPETGDTAYNQKFKGKATLTADKSSST
AYMELSSLTSEDSAVYYCTRANSFGYWGQGTTLTVSS.

In some embodiments, the anti-CD20 scFv comprises an amino acid sequence:

(SEQ ID NO: 392)
DIQMTQTTSSLSASLGDRVTISCRASQDISNYLNWYQQKPDGTVKLLIYY
TSRLHSGVPSRFSGSGSGTDYSLTISNLEQEDIATYFCQQGNTLPPTFGG
GTKLEIKGGGGSGGGGSGGGGSVQLQQSGAELARPGASVKLSCKASGYTF
TSYGISWKQRTGQGLEWIGEIYPRSGNTYYNEKFKGKATLTADKSSSTAY
MELRSLTSEDSAVYFCARSRVWGTGTTVTVSS.

In some embodiments, the anti-CD20 scFv comprises an amino acid sequence:

(SEQ ID NO: 393)
DIQMTQTTSSLSASLGDRVTISCRASQDISNYLNWYQQKPDGTVKLLIYY
TSRLHSGVPSRFSGSGSGTDYSLTISNLEQEDIATYFCQQGNTLPPTFGG
GTKLEIKGGGGSGGGGSGGGGSDVKLQESGGGLVKPGGSLKLSCAVSGFT
FSSFAMSWVRQTPEKRLEWVATISSGGAYTFYKDSVKGRFTISRDNAKNT
LYLQMSSLRSEDSAMYYCARHSGYDGYYLYAMDYWGQGTSVTVSS.

In some embodiments, the anti-CD20 scFv comprises an amino acid sequence:

(SEQ ID NO: 394)
DIQMTQTTSSLSASLGDRVTISCRASQDISNYLNWYQQKPDGTVKLLIYY
TSRLHSGVPSRFSGSGSGTDYSLTISNLEQEDIATYFCQQGNTLPPTFGG
GTKLEIKGGGGSGGGGSGGGGSEVKLVESGGDLVKPGASLKLSCAASGFT
FSNYGMSWIRQTSDKRLEWVASISSGDGRTYYSDNIRGRFTISSENAKNT
LYLQMSSLKSEDTALYYCTRGRGLRGDAMDYWGQGTSVTVSS.

In some embodiments, the anti-CD20 scFv comprises an amino acid sequence:

(SEQ ID NO: 395)
DIQMTQTTSSLSASLGDRVTISCRASQDISNYLNWYQQKPDGTVKLLIYY
TSRLHSGVPSRFSGSGSGTDYSLTISNLEQEDIATYFCQQGNTLPPTFGG
GTKLEIKGGGGSGGGGSGGGGSEVKLLESGGGLVQPGGSLKLSCAASGFD
FSRYWMSWVRQAPGKGLEWIGEINPDSSTINYTPSLKDKFIISRDNAKNT
LYLQMSKVRSEDTALYYCARPGYYYAMDYWGQGTSVTVSS.

In some embodiments, the anti-CD20 scFv comprises an amino acid sequence:

(SEQ ID NO: 396)
EIVLTQSPAITAASLGQKVTITCSASSSVSYMHWYQQKSGTSPKPWIYEI
SKLASGVPARFSGSGSGTSYSLTISSMEAEDAAIYYCQQWNYPLITFGGG
TKLEIGGGGSGGGGSGGGGSEVQLQESGAELVKPGASVKLSCTASGFNIK
DTYMHWVKQRPEQGLEWIGRIDPANGNVEYDPKFQGKATLTADTSSNTAY
LQLSSLTSEDTAVYYCDLSHYTMDYWGQGTSVTVSS.

In some embodiments, the anti-CD20 scFv comprises an amino acid sequence:

(SEQ ID NO: 397)
EIVLTQSPAITAASLGQKVTITCSASSSVSYMHWYQQKSGTSPKPWIYEI
SKLASGVPARFSGSGSGTSYSLTISSMEAEDAAIYYCQQWNYPLITFGGG
TKLEIGGGGSGGGGSGGGGSQVQLQQSGAELVRPGASVTLSCKASGYTFT
DYEMHWVKQTPVHGLEWIGAIDPETGDTAYNQKFKGKATLTADKSSSTAY
MELSSLTSEDSAVYYCTRANSFGYWGQGTTLTVSS.

In some embodiments, the anti-CD20 scFv comprises an amino acid sequence:

(SEQ ID NO: 398)
EIVLTQSPAITAASLGQKVTITCSASSSVSYMHWYQQKSGTSPKPWIYEI
SKLASGVPARFSGSGSGTSYSLTISSMEAEDAAIYYCQQWNYPLITFGGG
TKLEIGGGGSGGGGSGGGGSVQLQQSGAELARPGASVKLSCKASGYTFTS
YGISWVKQRTGQGLEWIGEIYPRSGNTYYNEKFKGKATLTADKSSSTAYM
ELRSLTSEDSAVYFCARSRVWGTGTTVTVSS.

In some embodiments, the anti-CD20 scFv comprises an amino acid sequence:

(SEQ ID NO: 399)
EIVLTQSPAITAASLGQKVTITCSASSSVSYMHWYQQKSGTSPKPWIYEI
SKLASGVPARFSGSGSGTSYSLTISSMEAEDAAIYYCQQWNYPLITFGGG
TKLEIGGGGSGGGGSGGGGSDVKLQESGGGLVKPGGSLKLSCAVSGFTFS
SFAMSWVRQTPEKRLEWVATISSGGAYTFYKDSVKGRFTISRDNAKNTLY
LQMSSLRSEDSAMYYCARHSGYDGYYLYAMDYWGQGTSVTVSS.

In some embodiments, the anti-CD20 scFv comprises an amino acid sequence:

(SEQ ID NO: 400)
EIVLTQSPAITAASLGQKVTITCSASSSVSYMHWYQQKSGTSPKPWIYEI
SKLASGVPARFSGSGSGTSYSLTISSMEAEDAAIYYCQQWNYPLITFGGG
TKLEIGGGGSGGGGSGGGGSEVKLVESGGDLVKPGASLKLSCAASGFTFS
NYGMSWIRQTSDKRLEWVASISSGDGRTYYSDNIRGRFTISSENAKNTLY
LQMSSLKSEDTALYYCTRGRGLRGDAMDYWGQGTSVTVSS.

In some embodiments, the anti-CD20 scFv comprises an amino acid sequence:

(SEQ ID NO: 401)
EIVLTQSPAITAASLGQKVTITCSASSSVSYMHWYQQKSGTSPKPWIYEI
SKLASGVPARFSGSGSGTSYSLTISSMEAEDAAIYYCQQWNYPLITFGGG
TKLEIGGGGGGGGSGGGGSEVKLLESGGGLVQPGGSLKLSCAASGFDFSR
YWMSWVRQAPGKGLEWIGEINPDSSTINYTPSLKDKFIISRDNAKNTLYL
QMSKVRSEDTALYYCARPGYYYAMDYWGQGTSVTVSS.

In some embodiments, the anti-CD20 scFv comprises an amino acid sequence:

(SEQ ID NO: 402)
DIVLTQSPASLAVSLGQRATISYRASKSVSTSGYSYMHWNQQKPGQPPRL
LIYLVSNLESGVPARFSGSGSGTDFTLNIHPVEEEDAATYYCQHIRELTR
SEGGPSWKGGGGSGGGGSGGGGSEVQLQESGAELVKPGASVKLSCTASGF
NIKDTYMHWVKQRPEQGLEWIGRIDPANGNVEYDPKFQGKATLTADTSSN
TAYLQLSSLTSEDTAVYYCDLSHYTMDYWGQGTSVTVSS.

In some embodiments, the anti-CD20 scFv comprises an amino acid sequence:

(SEQ ID NO: 403)
DIVLTQSPASLAVSLGQRATISYRASKSVSTSGYSYMHWNQQKPGQPPRL
LIYLVSNLESGVPARFSGSGSGTDFTLNIHPVEEEDAATYYCQHIRELTR
SEGGPSWKGGGGSGGGGSGGGGSQVQLQQSGAELVRPGASVTLSCKASGY
TFTDYEMHWVKQTPVHGLEWIGAIDPETGDTAYNQKFKGKATLTADKSSS
TAYMELSSLTSEDSAVYYCTRANSFGYWGQGTTLTVSS.

In some embodiments, the anti-CD20 scFv comprises an amino acid sequence:

(SEQ ID NO: 404)
DIVLTQSPASLAVSLGQRATISYRASKSVSTSGYSYMHWNQQKPGQPPRL
LIYLVSNLESGVPARFSGSGSGTDFTLNIHPVEEEDAATYYCQHIRELTR
SEGGPSWKGGGGSGGGGSGGGGSVQLQQSGAELARPGASVKLSCKASGYT
FTSYGISWVKQRTGQGLEWIGEIYPRSGNTYYNEKFKGKATLTADKSSST
AYMELRSLTSEDSAVYFCARSRVWGTGTTVTVSS.

In some embodiments, the anti-CD20 scFv comprises an amino acid sequence:

(SEQ ID NO: 405)
DIVLTQSPASLAVSLGQRATISYRASKSVSTSGYSYMHWNQQKPGQPPRL
LIYLVSNLESGVPARFSGSGSGTDFTLNIHPVEEEDAATYYCQHIRELTR
SEGGPSWKGGGGSGGGGSGGGGSDVKLQESGGGLVKPGGSLKLSCAVSGF
TFSSFAMSWVRQTPEKRLEWVATISSGGAYTFYKDSVKGRFTISRDNAKN
TLYLQMSSLRSEDSAMYYCARHSGYDGYYLYAMDYWGQGTSVTVSS.

In some embodiments, the anti-CD20 scFv comprises an amino acid sequence:

(SEQ ID NO: 406)
DIVLTQSPASLAVSLGQRATISYRASKSVSTSGYSYMHWNQQKPGQPPRL

LIYLVSNLESGVPARFSGSGSGTDFTLNIHPVEEEDAATYYCQHIRELTR

SEGGPSWKGGGGSGGGGSGGGGSEVKLVESGGDLVKPGASLKLSCAASGF

TFSNYGMSWIRQTSDKRLEWVASISSGDGRTYYSDNIRGRFTISSENAKN

TLYLQMSSLKSEDTALYYCTRGRGLRGDAMDYWGQGTSVTVSS.

In some embodiments, the anti-CD20 scFv comprises an amino acid sequence:

(SEQ ID NO: 407)
DIVLTQSPASLAVSLGQRATISYRASKSVSTSGYSYMHWNQQKPGQPPRL

LIYLVSNLESGVPARFSGSGSGTDFTLNIHPVEEEDAATYYCQHIRELTR

SEGGPSWKGGGGSGGGGSGGGGSEVKLLESGGGLVQPGGSLKLSCAASGF

DFSRYWMSWVRQAPGKGLEWIGEINPDSSTINYTPSLKDKFIISRDNAKN

TLYLQMSKVRSEDTALYYCARPGYYYAMDYWGQGTSVTVSS.

In some embodiments, the anti-CD20 scFv binds to CD20 and comprises an amino acid sequence that is 95%, 96%, 97%, 98% or 99% identical to any of the specific anti-CD20 scFv amino acid sequences disclosed herein.

In some embodiments, the anti-CD20 scFv comprises an antigen binding domain of veltuzumab (hA20 IMMU-106, Immunomedics, Inc.).

In some embodiments, the anti-CD20 scFv comprises an antigen binding domain of rituximab (IDEC-C2B8), described in U.S. Pat. No. 7,682,612, which is incorporated by reference for the teaching of this antibody.

In some embodiments, the anti-CD20 scFv comprises an antigen binding domain of clone Leu16.

In some embodiments, the anti-CD20 scFv comprises an antigen binding domain of tositumomab (Bexxar, GSK).

In some embodiments, the anti-CD20 scFv comprises an antigen binding domain of ocrelizumab (hu2H7, Biogen/Genentech), described in EP2301966, which is incorporated by reference for the teaching of this antibody.

In some embodiments, the anti-CD20 scFv comprises an antigen binding domain of ibritumomab tiuxetan (Zevalin, Spectrum Pharmaceuticals).

In some embodiments, the anti-CD20 scFv comprises an antigen binding domain of ofatumumab (Arzerra, GSK), described in U.S. Pat. No. 7,850,962, which is incorporated by reference for the teaching of this antibody.

In some embodiments, the anti-CD20 scFv comprises an antigen binding domain of obinutuzumab (Gazyva, GA101), described in EP1692182, which is incorporated by reference for the teaching of this antibody.

In some embodiments, the anti-CD20 scFv comprises an antigen binding domain of ocaratuzumab (AME/Eli Lilly, now Mentrik), described in US20030219433, which is incorporated by reference for the teaching of this antibody.

Anti-CD22 scFv

In some embodiments, the anti-CD22 scFv is derived from hybridoma from CD22 plate 1 (CD22 (L) NS1)), CD22 plate 2 (CD22 (L) NS1)), CD22 plate 3 (CD22 (L) NS1)), CD22 plate 4 (CD22 (L) NS1)), CD22 plate 5 (CD22 (L) NS1)), CD22 plate 6 (CD22 (L) NS1)), CD22 plate 7 (CD22 (L) NS1)), CD22 plate 8 (CD22 (L) NS1)), CD22 plate 9 (CD22 (L) SP20)), CD22 plate 10 (CD22 (L) SP20)), CD22 plate 11 (CD22 (L) SP20)), CD22 plate 12 (CD22 (L) SP20)), CD22 plate 13 (CD22 (O) NS1)), CD22 plate 14 (CD22 (O) NS1)), CD22 plate 15 (CD22 (O) NS1)), CD22 plate 16 (CD22 (O) NS1)), CD22 plate 17 (CD22 (O) SP20)), CD22 plate 18 (CD22 (O) SP20)), CD22 plate 19 (CD22 (O) SP20)), or CD22 plate 20 (CD22 (O) SP20)). Each plate has 96 wells consisting of 8 columns (A-H) and 12 rows (1-12), so each well contains 96 hybridomas identified by their plate and well, e.g. "CD22 Plate1-A1". In some embodiments, the anti-CD22 scFv can comprise a variable heavy ($V_H$) domain having CDR1, CDR2 and CDR3 sequences and a variable light ($V_L$) domain having CDR1, CDR2 and CDR3 sequences.

In some embodiments, the anti-CD22 scFv is derived from hybridoma 2B12, 5H12, 10C1, 10H6, 18A3, 9D4, 11D11, or 20B4.

In some embodiments, the anti-CD22 scFv can comprise a variable heavy ($V_H$) domain having CDR1, CDR2 and CDR3 sequences and a variable light ($V_L$) domain having CDR1, CDR2 and CDR3 sequences.

For example, in some embodiments, the CDR1 sequence of the $V_H$ domain comprises the amino acid sequence GYTFTSYW (SEQ ID NO:408), GFTFSSFG (SEQ ID NO:409), GFEFSRYW (SEQ ID NO:410), GFSLTGYG (SEQ ID NO:411), GFTFSNYG (SEQ ID NO:412), GYAFSSSW (SEQ ID NO:413), or SFAMSW (SEQ ID NO:414); CDR2 sequence of the $V_H$ domain comprises the amino acid sequence INPNSGST (SEQ ID NO:415), ISSGSSTL (SEQ ID NO:416), VNPDSSTI (SEQ ID NO:417), IWGDGST (SEQ ID NO:418), IYPGNSDT (SEQ ID NO:419), ISSGGGRI (SEQ ID NO:420), IYPGDGDT (SEQ ID NO:421), or TISSGGAYTFYKDSVKGRFT (SEQ ID NO:422); CDR3 sequence of the $V_H$ domain comprises the amino acid sequence TRPGV (SEQ ID NO:423), GRDSNYGYFDV (SEQ ID NO:424), ARGGYDFDY (SEQ ID NO:425), TRSHYVEGYFDV (SEQ ID NO:426), SQSTHVSYT (SEQ ID NO:27), ANSNYPSSQSSR-TYSRRDWFAY (SEQ ID NO:428), or HSGYDGYY-LYAMDC (SEQ ID NO:429); CDR1 sequence of the $V_L$ comprises the amino acid sequence QSIVHSNGNTY (SEQ ID NO:430), ENIYGA (SEQ ID NO:431), QSVDYDGDSY (SEQ ID NO:432), SSVSY (SEQ ID NO:433), KSISKY (SEQ ID NO:434), QSLVHSNGNTY (SEQ ID NO:435), SSVSD (SEQ ID NO:436), or RASESVDSYGNSFMH (SEQ ID NO:437); CDR2 sequence of the $V_L$ domain comprises the amino acid sequence KVS (SEQ ID NO:438), GAT (SEQ ID NO:439), AAS (SEQ ID NO:440), RTS (SEQ ID NO:441), SGS (SEQ ID NO:442), KVS (SEQ ID NO:443), DTS (SEQ ID NO:444), or LASNLES (SEQ ID NO:445); and CDR3 sequence of the $V_L$ domain comprises the amino acid sequence FQGSHVPPT (SEQ ID NO:446), QNVLSTPWT (SEQ ID NO:447), QQSNEDPFT (SEQ ID NO:448), QQYHSYPYT (SEQ ID NO:449), QQHNEY-PWT (SEQ ID NO:450), SQSTHVSYT (SEQ ID NO:451), QQWSSNPLT (SEQ ID NO:452), or NNEDPWT (SEQ ID NO:453).

Therefore, in some embodiments, the anti-CD22 scFv $V_H$ domain comprises the amino acid sequence:

(SEQ ID NO: 454, 2B12)
QVKLQQSGAELGKPGTSVKLSCKASGYTFTSYWMHWVKQRPGQGLEWIGN

INPNSGSTNYNEKFKSKATLTVDKSSSTAYMQLSTLTSEDSAVYYCTRPG

VWGTGTTVTVSS.

Therefore, in some embodiments, the anti-CD22 scFv $V_H$ domain is encoded (SEQ ID NO: 470, 2B12)
CAAGTTAAGCTGCAGCAGTCTGGGGCTGAACTGGGCAAGCCTGGGACATC

AGTGAAGCTGTCCTGCAAGGCTTCTGGCTACACCTTCACCAGCTATTGGA

TGCACTGGGTGAAGCAGAGGCCTGGACAAGGCCTTGAGTGGATTGGAAAT

ATTAATCCTAATAGTGGTAGTACTAACTACAATGAGAAGTTCAAGAGCAA

GGCCACACTGACTGTAGACAAATCCTCCAGCACAGCCTACATGCAGCTCA

GCACCCTGACATCTGAGGACTCTGCGGTCTACTACTGTACAAGACCGGGG

GTCTGGGGCACAGGGACCACGGTCACCGTCTCCTCA.

Therefore, in some embodiments, the anti-CD22 scFv $V_H$ domain comprises the amino acid sequence:

(SEQ ID NO: 455, 5H12)
EVKLQQSGGGLVQPGGSRKLSCAASGFTFSSFGMHWVRQAPEKGLEWVAY

ISSGSSTLHYADTVKGRFTISRDNPKNTLFLQMKLPSLCYGLLGSRNLSH

RLLSQNDTPICL.

Therefore, in some embodiments, the anti-CD22 scFv $V_H$ domain is encoded by the nucleic acid sequence:

(SEQ ID NO: 471, 5H12)
GAGGTGAAGCTGCAGCAGTCTGGGGGAGGCTTAGTGCAGCCTGGAGGGTC

CCGGAAACTCTCCTGTGCAGCCTCTGGATTCACTTTCAGTAGCTTTGGAA

TGCACTGGGTTCGTCAGGCTCCAGAGAAGGGGCTGGAGTGGGTCGCATAC

ATTAGTAGTGGCAGTAGTACCCTCCACTATGCAGACACAGTGAAGGGCCG

ATTCACCATCTCCAGAGACAATCCCAAGAACACCCTGTTCCTGCAAATGA

AACTACCCTCACTATGCTATGGACTACTGGGGTCAAGGAACCTCAGTCAC

CGTCTCCTCAGCCAAAACGACACCCCCATCTGCCTA.

Therefore, in some embodiments, the anti-CD22 scFv $V_H$ domain comprises the amino acid sequence:

(SEQ ID NO: 456, 10C1)
VKLLESGGGLVQPGGSLKLSCAASGFEFSRYWMSWVRQVPGKGLEWIGEV

NPDSSTINYTTSLKDKFIISRDNAKNTLYLQMSKVRSEDTALYYCGRDSN

YGYFDVWGTGTTVTVSS.

Therefore, in some embodiments, the anti-CD22 scFv $V_H$ domain is encoded by the nucleic acid sequence:

(SEQ ID NO: 472, 10C1)
GTGAAGCTTCTCGAGTCTGGAGGTGGCCTGGTGCAGCCTGGAGGATCCCT

GAAACTCTCCTGTGCAGCCTCAGGATTCGAATTTAGTAGATACTGGATGA

GTTGGGTCCGGCAGGTTCCAGGGAAAGGGCTAGAATGGATTGGAGAAGTT

AATCCAGATAGCAGTACGATAAACTATACGACATCTCTAAAGGATAAATT

CATCATCTCCAGAGACAACGCCAAAAATACGCTGTACCTGCAAATGAGCA

AAGTGAGATCTGAGGACACAGCCCTTTATTACTGTGGAAGAGATAGTAAT

TACGGGTACTTCGATGTCTGGGGCACAGGGACCACGGTCACCGTCTCCTC

A.

Therefore, in some embodiments, the anti-CD22 scFv $V_H$ domain comprises the amino acid sequence:

(SEQ ID NO: 457, 10H6)
VQLKESGPGLVAPSQSLSITCTVSGFSLTGYGVNWVRQPPGKGLEWLGMI

WGDGSTDYNSALKSRLSISKDNSKSQVFLKMNSLQTDDTARYYCARGGYD

FDYWGQGTTLTVSS.

Therefore, in some embodiments, the anti-CD22 scFv $V_H$ domain is encoded by the nucleic acid sequence:

(SEQ ID NO: 473, 10H6)
GTGCAGCTGAAGGAGTCAGGACCTGGCCTGGTGGCGCCCTCACAGAGCCT

GTCCATCACATGCACCGTCTCAGGGTTCTCATTAACCGGCTATGGTGTAA

ACTGGGTTCGCCAGCCTCCAGGAAAGGGTCTGGAGTGGCTGGGAATGATA

TGGGGTGATGGAAGCACAGACTATAATTCAGCTCTCAAATCCAGACTGAG

CATCAGCAAGGACAACTCCAAGAGCCAAGTTTTCTTAAAAATGAACAGTC

TGCAAACTGATGACACAGCCAGGTACTACTGTGCCAGAGGAGGCTACGAC

TTTGACTACTGGGGCCAAGGCACCACTCTCACAGTCTCCTCA.

Therefore, in some embodiments, the anti-CD22 scFv $V_H$ domain comprises the amino acid sequence:

(SEQ ID NO: 458, 18A3)
VQLQQSGAELARPGASVKMSCKASGYTFTSYWMHWVKQRPGQGLEWIGAI

YPGNSDTSYNQKFKGKAKLTAVTSASTAYMELSSLTNEDSAVYYCTRSHY

VEGYFDVWGTGTTVTVSS.

Therefore, in some embodiments, the anti-CD22 scFv $V_H$ domain is encoded by the nucleic acid sequence:

(SEQ ID NO: 474, 18A3)
GTTCAGCTCCAGCAGTCTGGGGCTGAGCTGGCAAGACCTGGGGCTTCAGT

GAAGATGTCCTGCAAGGCTTCTGGCTACACCTTTACCAGCTACTGGATGC

ACTGGGTAAAACAGAGGCCTGGACAGGGTCTGGAATGGATTGGCGCTATT

TATCCTGGAAATAGTGATACTAGCTACAATCAGAAGTTCAAGGGCAAGGC

CAAACTGACTGCAGTCACATCCGCCAGCACTGCCTACATGGAGCTCAGCA

GCCTAACAAATGAGGACTCTGCGGTCTATTACTGTACAAGAAGCCACTAC

GTAGAGGGATACTTCGATGTCTGGGGCACAGGGACCACGGTCACCGTCTC

CTCA.

Therefore, in some embodiments, the anti-CD22 scFv $V_H$ domain comprises the amino acid sequence:

(SEQ ID NO: 459, 9D4)
QVKLQQSGAELVKPGASVKISCKASGYAFSSSWMNWVKQRPGKGLEWIGQ

IYPGDGDTKYNGKFKGKATLTADKSSSTAYMQLSSLTSEDSAVYFCANSN

YPSSQSSRTYSRRDWFAYWGQGTLVTVSA.

Therefore, in some embodiments, the anti-CD22 scFv $V_H$ domain is encoded by the nucleic acid sequence:

(SEQ ID NO: 475, 9D4)
CAAGTTAAGCTGCAGCAGTCTGGGGCTGAGCTGGTGAAGCCTGGGGCCTC

AGTGAAGATTTCCTGCAAAGCTTCTGGCTACGCATTCAGTAGCTCCTGGA

TGAACTGGGTGAAGCAGAGGCCTGGAAAGGGTCTTGAGTGGATTGGACAG

ATTTATCCTGGAGATGGTGATACTAAGTACAATGGAAAGTTCAAGGGCAA

AGCCACACTGACTGCAGACAAATCCTCCAGCACAGCCTACATGCAACTCA

GCAGCCTGACATCTGAGGACTCTGCGGTCTATTTCTGTGCAAATAGTAAC

TACCCCAGTAGTCAAAGTAGTCGTACCTATAGTAGAAGGGACTGGTTTGC

TTACTGGGGCCAAGGGACTCTGGTCACTGTCTCTGCA.

Therefore, in some embodiments, the anti-CD22 scFv $V_H$ domain comprises the amino acid sequence:

(SEQ ID NO: 460, 11D11)
DVKLQESGGGLVKPGGSLKLSCAVSGFTFSSFAMSWVRQTPEKRLEWVAT

ISSGGAYTFYKDSVKGRFTISRDNAKNTLYLQMSSLRSEDSAMYYCARHS

GYDGYYLYAMDCWGQGTSVTVSS.

Therefore, in some embodiments, the anti-CD22 scFv $V_H$ domain is encoded by the nucleic acid sequence:

(SEQ ID NO: 476, 11D11)
GATGTGAAGCTTCAGGAGTCTGGGGGAGGCTTAGTGAAGCCTGGAGGGTC

CCTGAAACTCTCCTGTGCAGTCTCTGGATTCACTTTCAGTTCCTTTGCCA

TGTCTTGGGTTCGCCAGACTCCGGAGAAGAGGCTGGAGTGGGTCGCAACC

ATTAGTAGTGGTGGAGCTTACACCTTCTATAAAGACAGTGTGAAGGGGCG

ATTCACCATCTCCAGAGACAATGCCAAGAATACCCTGTACCTGCAAATGA

GCAGTCTGAGGTCTGAGGACTCGGCCATGTATTACTGTGCAAGACATAGC

GGCTATGATGGTTACTACCTCTATGCTATGGACTGCTGGGGTCAAGGAAC

CTCAGTCACCGTCTCCTCA.

Therefore, in some embodiments, the anti-CD22 scFv $V_H$ domain comprises the amino acid sequence:

(SEQ ID NO: 461, 20B4)
EVKLQQSGGGLVKPGASLKLSCAASGFTFSNYGMSWVRQTSDKRLEWVAS

ISSGGGRIYYPDNVKGRFTISRENAKNTLYLQMNSLKSDDTALYYCAREP

PNYYGGTYGDYWGQGTTLTVSS.

Therefore, in some embodiments, the anti-CD22 scFv $V_H$ domain is encoded by the nucleic acid sequence:

(SEQ ID NO: 477, 20B4)
GAGGTCAAGCTGCAGCAGTCTGGGGGAGGCTTAGTGAAGCCTGGAGCGTC

TCTGAAACTCTCCTGTGCAGCCTCTGGATTCACTTTCAGTAACTATGGCA

TGTCTTGGGTTCGCCAGACTTCAGACAAGAGGCTGGAGTGGGTCGCATCC

ATTAGTAGTGGTGGTGGTAGGATATACTATCCAGACAATGTAAAGGGCCG

ATTCACCATCTCCAGAGAAAATGCCAAGAACACCCTGTACCTGCAAATGA

ATAGTCTGAAGTCTGACGACACGGCCTTGTATTACTGTGCAAGAGAGCCC

CCTAATTACTATGGTGGTACCTACGGAGACTACTGGGGCCAAGGCACCAC

TCTCACAGTCTCCTCA.

In some embodiments, the anti-CD22 scFv $V_L$ domain comprises the amino acid sequence:

(SEQ ID NO: 462, 2B12)
DVLMTQTPLSLPVSLGDQASISCRSSQSIVHSNGNTYLEWYLQKPGQSPK

LLIYKVSNRFSGVPDRFSGSGSGTDFTLKISRVEAEDLGVYYCFQGSHVP

PTFGGGTKLEIKR.

Therefore, in some embodiments, the anti-CD22 scFv $V_L$ domain is encoded by the nucleic acid sequence:

(SEQ ID NO: 478, 2B12)
GATGTTTTGATGACCCAAACTCCACTCTCCCTGCCTGTCAGTCTTGGAGA

TCAAGCCTCCATCTCTTGCAGATCTAGTCAGAGCATTGTACATAGTAATG

GAAACACCTATTTAGAATGGTACCTGCAGAAACCAGGCCAGTCTCCAAAG

CTCCTGATCTACAAAGTTTCCAACCGATTTTCTGGGGTCCCAGACAGGTT

CAGTGGCAGTGGATCAGGGACAGATTTCACACTCAAGATCAGCAGAGTGG

AGGCTGAGGATCTGGGAGTTTATTACTGCTTTCAAGGTTCACATGTTCCT

CCGACGTTCGGTGGAGGCACCAAGCTGGAAATCAAACGG.

In some embodiments, the anti-CD22 scFv $V_L$ domain comprises the amino acid sequence:

(SEQ ID NO: 463, 5H12)
DIQMTQSPASLSASVGETVTITCGASENIYGALNWYQRKQGKSPQLLIYG

ATNLADGMSSRFSGSGSGRQYSLKISSLHPDDVATYYCQNVLSTPWTFGG

GTKLEIKR.

Therefore, in some embodiments, the anti-CD22 scFv $V_L$ domain is encoded by the nucleic acid sequence:

(SEQ ID NO: 479, 5H12)
GACATCCAGATGACTCAGTCTCCAGCTTCACTGTCTGCATCTGTGGGAGA

AACTGTCACCATCACATGTGGAGCAAGTGAGAATATTTACGGTGCTTTAA

ATTGGTATCAGCGGAAACAGGGAAAATCTCCTCAGCTCCTGATCTATGGT

GCAACCAACTTGGCAGATGGCATGTCATCGAGGTTCAGTGGCAGTGGATC

TGGTAGACAGTATTCTCTCAAGATCAGTAGCCTGCATCCTGACGATGTTG

CAACGTATTACTGTCAAAATGTGTTAAGTACTCCGTGGACGTTCGGTGGA

GGCACCAAGCTGGAAATCAAACGG.

In some embodiments, the anti-CD22 scFv $V_L$ domain comprises the amino acid sequence:

(SEQ ID NO: 464, 10C1)
DIVLTQSPASLAVSLGQRATISCKASQSVDYDGDSYMNWYQQKPGQPPKL

LIYAASNLESGIPARFSGSGSGTDFTLNIHPVEEEDAATYYCQQSNEDPF

TFGSGTKLEIKR.

Therefore, in some embodiments, the anti-CD22 scFv $V_L$ domain is encoded (SEQ ID NO: 480, 10C1)
GACATTGTGCTGACCCAATCTCCAGCTTCTTTGGCTGTGTCTCTAGGGCA

GAGGGCCACCATCTCCTGCAAGGCCAGCCAAAGTGTTGATTATGATGGTG

ATAGTTATATGAACTGGTACCAACAGAAACCAGGACAGCCACCCAAACTC

CTCATCTATGCTGCATCCAATCTAGAATCTGGGATCCCAGCCAGGTTTAG

TGGCAGTGGGTCTGGGACAGACTTCACCCTCAACATCCATCCTGTGGAGG

AGGAGGATGCTGCAACCTATTACTGTCAGCAAAGTAATGAGGATCCATTC

ACGTTCGGCTCGGGGACAAAGTTGGAAATAAAACGG.

In some embodiments, the anti-CD22 scFv $V_L$ domain comprises the amino acid sequence:

(SEQ ID NO: 465, 10H6)
DIVLTQSPAIMSASPGEKVTISCSASSSVSYMYWYQQKPGSSPKPWIYRT

SNLASGVPARFSGSGSGTSYSLTISSMEAEDAATYYCQQYHSYPYTFGGG

TKLEIKR.

Therefore, in some embodiments, the anti-CD22 scFv $V_L$ domain is encoded by the nucleic acid sequence:

(SEQ ID NO: 481, 10H6)
GATATTGTGCTGACACAGTCTCCAGCAATCATGTCTGCATCTCCAGGGGA

GAAGGTCACCATATCCTGCAGTGCCAGCTCAAGTGTAAGTTACATGTACT

GGTACCAGCAGAAGCCAGGATCCTCCCCCAAACCCTGGATTTATCGCACA

TCCAACCTGGCTTCTGGAGTCCCTGCTCGCTTCAGTGGCAGTGGGTCTGG

GACCTCTTACTCTCTCACAATCAGCAGCATGGAGGCTGAAGATGCTGCCA

CTTATTACTGCCAGCAGTATCATAGTTACCCGTACACGTTCGGAGGGGGG

ACCAAGCTGGAAATAAAACGG.

In some embodiments, the anti-CD22 scFv $V_L$ domain comprises the amino acid sequence:

(SEQ ID NO: 466, 18A3)
DVQITQSPSYLAASPGETITINCRASKSISKYLAWYQEKPGKTNKLLIYS

GSTLQSGIPSRFSGSGSGTDFTLTISSLEPEDFAMYYCQQHNEYPWTFGG

GTKLEIKR.

Therefore, in some embodiments, the anti-CD22 scFv $V_L$ domain is encoded by the nucleic acid sequence:

(SEQ ID NO: 482, 18A3)
GATGTCCAGATAACCCAGTCTCCATCTTATCTTGCTGCATCTCCTGGAGA

AACCATTACTATTAATTGCAGGGCAAGTAAGAGCATTAGCAAATATTTAG

CCTGGTATCAAGAGAAACCTGGGAAAACTAATAAGCTTCTTATCTACTCT

GGATCCACTTTGCAATCTGGAATTCCATCAAGGTTCAGTGGCAGTGGATC

TGGTACAGATTTCACTCTCACCATCAGTAGCCTGGAGCCTGAAGATTTTG

CAATGTATTACTGTCAACAGCATAATGAATACCCGTGGACGTTCGGTGGA

GGCACCAAGCTGGAAATCAAACGG.

Therefore, in some embodiments, the anti-CD22 scFv $V_L$ domain comprises the amino acid sequence:

(SEQ ID NO: 467, 9D4)
QIVLTQSPVIMSASPGEKVTMTCSASSSVSDMHWYQQKSGTSPKRWIYDT

SKLASGVPARFSGSGSGTSYSLTISSMEAEDAATYYCQQWSSNPLTFGAG

TKLELKR.

Therefore, in some embodiments, the anti-CD22 scFv $V_L$ domain is encoded by the nucleic acid sequence:

(SEQ ID NO: 483, 9D4)
CAAATTGTTCTCACCCAGTCTCCAGTAATCATGTCTGCATCTCCAGGGGA

GAAGGTCACCATGACCTGCAGTGCCAGCTCAAGTGTAAGTGACATGCACT

GGTACCAGCAGAAGTCAGGCACCTCCCCCAAAAGATGGATTTATGACACA

TCCAAACTGGCTTCTGGAGTCCCTGCTCGCTTCAGTGGCAGTGGGTCTGG

GACCTCTTACTCTCTCACAATCAGCAGCATGGAGGCTGAAGATGCTGCCA

CTTATTACTGCCAGCAGTGGAGTAGTAACCCGCTCACGTTCGGTGCTGGG

ACCAAGCTGGAGCTGAAACGG.

Therefore, in some embodiments, the anti-CD22 scFv $V_L$ domain comprises the amino acid sequence:

(SEQ ID NO: 468, 11D11)
NIVLTQSPASLAVSLGQRATISCRASESVDSYGNSFMHWYQQKPGQPPKL

LIYLASNLESGVPARFSGSGSRTDFTLTIDPVEADDAATYYCQQNNEDPW

TFGGGTKLEIK.

Therefore, in some embodiments, the anti-CD22 scFv $V_L$ domain is encoded by the nucleic acid sequence:

(SEQ ID NO: 484, 11D11)
AACATTGTGCTGACCCAATCTCCAGCTTCTTTGGCTGTGTCTCTAGGGCA

GAGGGCCACCATATCCTGCAGAGCCAGTGAAAGTGTTGATAGTTATGGCA

ATAGTTTTATGCACTGGTACCAGCAGAAACCAGGACAGCCACCCAAACTC

CTCATCTATCTTGCATCCAACCTAGAATCTGGGGTCCCTGCCAGGTTCAG

TGGCAGTGGGTCTAGGACAGACTTCACCCTCACCATTGATCCTGTGGAGG

CTGATGATGCTGCAACCTATTACTGTCAGCAAAATAATGAGGATCCGTGG

ACGTTCGGTGGAGGCACCAAGCTGGAAATCAAA.

Therefore, in some embodiments, the anti-CD22 scFv $V_L$ domain comprises the amino acid sequence:

(SEQ ID NO: 469, 20B4)
DVVMTQSPLSLPVSLGDQASISCRSSQSLVHSNGNTYLHWYLQKPGQSPK

LLIYKVSNRFSGVPDRFSGSGSGTDFTLKISRVEAEDLGVYFCSQSTHVS

YTFGGGTKLEIKR.

Therefore, in some embodiments, the anti-CD22 scFv $V_L$ domain is encoded by the nucleic acid sequence:

(SEQ ID NO: 485, 20B4)
GATGTTGTGATGACCCAAAGTCCACTCTCCCTGCCTGTCAGTCTAGGAGA

TCAAGCCTCCATCTCTTGCAGATCTAGTCAGAGCCTTGTACACAGTAATG

GAAACACCTATTTACATTGGTACCTGCAGAAGCCAGGCCAGTCTCCAAAG

CTCCTGATCTACAAAGTTTCCAACCGATTTTCTGGGGTCCCAGACAGGTT

CAGTGGCAGTGGATCAGGGACAGATTTCACACTCAAGATCAGCAGAGTGG

AGGCTGAGGATCTGGGAGTTTATTTCTGCTCTCAAAGTACACATGTTTCG

TACACGTTCGGAGGGGGGACCAAACTGGAAATAAAACGG.

In some embodiments, the anti-CD22 scFv comprises an amino acid sequence:

(SEQ ID NO: 486)
QVKLQQSGAELGKPGTSVKLSCKASGYTFTSYWMHWVKQRPGQGLEWIGN

INPNSGSTNYNEKFKSKATLTVDKSSSTAYMQLSTLTSEDSAVYYCTRPG

VWGTGTTVTVSSGGGGSGGGGSGGGGSDVLMTQTPLSLPVSLGDQASISC

RSSQSIVHSNGNTYLEWYLQKPGQSPKLLIYKVSNRFSGVPDRFSGSGSG

TDFTLKISRVEAEDLGVYYCFQGSHVPPTFGGGTKLEIKR.

In some embodiments, the anti-CD22 scFv comprises an amino acid sequence:

(SEQ ID NO: 487)
QVKLQQSGAELGKPGTSVKLSCKASGYTFTSYWMHWVKQRPGQGLEWIGN

INPNSGSTNYNEKFKSKATLTVDKSSSTAYMQLSTLTSEDSAVYYCTRPG

VWGTGTTVTVSSGGGGGGGSGGGGSDIQMTQSPASLSASVGETVTITCG

ASENIYGALNWYQRKQGKSPQLLIYGATNLADGMSSRFSGSGSGRQYSLK

ISSLHPDDVATYYCQNVLSTPWTFGGGTKLEIKR.

In some embodiments, the anti-CD22 scFv comprises an amino acid sequence:

(SEQ ID NO: 488)
QVKLQQSGAELGKPGTSVKLSCKASGYTFTSYWMHWVKQRPGQGLEWIGN

INPNSGSTNYNEKFKSKATLTVDKSSSTAYMQLSTLTSEDSAVYYCTRPG

VWGTGTTVTVSSGGGGSGGGGSGGGGSDIVLTQSPASLAVSLGQRATISC

KASQSVDYDGDSYMNWYQQKPGQPPKLLIYAASNLESGIPARFSGSGSGT

DFTLNIHPVEEEDAATYYCQQSNEDPFTFGSGTKLEIKR.

In some embodiments, the anti-CD22 scFv comprises an amino acid sequence:

(SEQ ID NO: 489)
QVKLQQSGAELGKPGTSVKLSCKASGYTFTSYWMHWVKQRPGQGLEWIGN

INPNSGSTNYNEKFKSKATLTVDKSSSTAYMQLSTLTSEDSAVYYCTRPG

VWGTGTTVTVSSGGGGSGGGGSGGGGSDIVLTQSPAIMSASPGEKVTISC

SASSSVSYMYWYQQKPGSSPKPWIYRTSNLASGVPARFSGSGSGTSYSLT

ISSMEAEDAATYYCQQYHSYPYTFGGGTKLEIKR.

In some embodiments, the anti-CD22 scFv comprises an amino acid sequence:

(SEQ ID NO: 490)
QVKLQQSGAELGKPGTSVKLSCKASGYTFTSYWMHWVKQRPGQGLEWIGN

INPNSGSTNYNEKFKSKATLTVDKSSSTAYMQLSTLTSEDSAVYYCTRPG

VWGTGTTVTVSSGGGGSGGGGSGGGGSDVQITQSPSYLAASPGETITINC

RASKSISKYLAWYQEKPGKTNKLLIYSGSTLQSGIPSRFSGSGSGTDFTL

TISSLEPEDFAMYYCQQHNEYPWTFGGGTKLEIKR.

In some embodiments, the anti-CD22 scFv comprises an amino acid sequence:

(SEQ ID NO: 491)
QVKLQQSGAELGKPGTSVKLSCKASGYTFTSYWMHWVKQRPGQGLEWIGN

INPNSGSTNYNEKFKSKATLTVDKSSSTAYMQLSTLTSEDSAVYYCTRPG

VWGTGTTVTVSSGGGGSGGGGSGGGGSQIVLTQSPVIMSASPGEKVTMTC

SASSSVSDMHWYQQKSGTSPKRWIYDTSKLASGVPARFSGSGSGTSYSLT

ISSMEAEDAATYYCQQWSSNPLTFGAGTKLELKR.

In some embodiments, the anti-CD22 scFv comprises an amino acid sequence:

(SEQ ID NO: 492)
QVKLQQSGAELGKPGTSVKLSCKASGYTFTSYWMHWVKQRPGQGLEWIGN

INPNSGSTNYNEKFKSKATLTVDKSSSTAYMQLSTLTSEDSAVYYCTRPG

VWGTGTTVTVSSGGGGSGGGGSGGGGSNIVLTQSPASLAVSLGQRATISC

RASESVDSYGNSFMHWYQQKPGQPPKLLIYLASNLESGVPARFSGSGSRT

DFTLTIDPVEADDAATYYCQQNNEDPWTFGGGTKLEIK.

In some embodiments, the anti-CD22 scFv comprises an amino acid sequence:

(SEQ ID NO: 493)
QVKLQQSGAELGKPGTSVKLSCKASGYTFTSYWMHWVKQRPGQGLEWIGN

INPNSGSTNYNEKFKSKATLTVDKSSSTAYMQLSTLTSEDSAVYYCTRPG

VWGTGTTVTVSSGGGGSGGGGSGGGGSDVVMTQSPLSLPVSLGDQASISC

RSSQSLVHSNGNTYLHWYLQKPGQSPKLLIYKVSNRFSGVPDRFSGSGSG

TDFTLKISRVEAEDLGVYFCSQSTHVSYTFGGGTKLEIKR.

In some embodiments, the anti-CD22 scFv comprises an amino acid sequence:

(SEQ ID NO: 494)
EVKLQQSGGGLVQPGGSRKLSCAASGFTFSSFGMHWVRQAPEKGLEWVAY
ISSGSSTLHYADTVKGRFTISRDNPKNTLFLQMKLPSLCYGLLGSRNLSH
RLLSQNDTPICLGGGGSGGGGSGGGGSDVLMTQTPLSLPVSLGDQASISC
RSSQSIVHSNGNTYLEWYLQKPGQSPKLLIYKVSNRFSGVPDRFSGSGSG
TDFTLKISRVEAEDLGVYYCFQGSHVPPTFGGGTKLEIKR.

In some embodiments, the anti-CD22 scFv comprises an amino acid sequence:

(SEQ ID NO: 495)
EVKLQQSGGGLVQPGGSRKLSCAASGFTFSSFGMHWVRQAPEKGLEWVAY
ISSGSSTLHYADTVKGRFTISRDNPKNTLFLQMKLPSLCYGLLGSRNLSH
RLLSQNDTPICLGGGGSGGGGSGGGGSDIQMTQSPASLSASVGETVTITC
GASENIYGALNWYQRKQGKSPQLLIYGATNLADGMSSRFSGSGSGRQYSL
KISSLHPDDVATYYCQNVLSTPWTFGGGTKLEIKR.

In some embodiments, the anti-CD22 scFv comprises an amino acid sequence:

(SEQ ID NO: 496)
EVKLQQSGGGLVQPGGSRKLSCAASGFTFSSFGMHWVRQAPEKGLEWVAY
ISSGSSTLHYADTVKGRFTISRDNPKNTLFLQMKLPSLCYGLLGSRNLSH
RLLSQNDTPICLGGGGSGGGGSGGGGSDIVLTQSPASLAVSLGQRATISC
KASQSVDYDGDSYMNWYQQKPGQPPKLLIYAASNLESGIPARFSGSGSGT
DFTLNIHPVEEEDAATYYCQQSNEDPFTFGSGTKLEIKR.

In some embodiments, the anti-CD22 scFv comprises an amino acid sequence:

(SEQ ID NO: 497)
EVKLQQSGGGLVQPGGSRKLSCAASGFTFSSFGMHWVRQAPEKGLEWVAY
ISSGSSTLHYADTVKGRFTISRDNPKNTLFLQMKLPSLCYGLLGSRNLSH
RLLSQNDTPICLGGGGSGGGGSGGGGSDIVLTQSPAIMSASPGEKVTISC
SASSSVSYMYWYQQKPGSSPKPWIYRTSNLASGVPARFSGSGSGTSYSLT
ISSMEAEDAATYYCQQYHSYPYTFGGGTKLEIKR.

In some embodiments, the anti-CD22 scFv comprises an amino acid sequence:

(SEQ ID NO: 498)
EVKLQQSGGGLVQPGGSRKLSCAASGFTFSSFGMHWVRQAPEKGLEWVAY
ISSGSSTLHYADTVKGRFTISRDNPKNTLFLQMKLPSLCYGLLGSRNLSH
RLLSQNDTPICLGGGGSGGGGSGGGGSDVQITQSPSYLAASPGETITINC
RASKSISKYLAWYQEKPGKTNKLLIYSGSTLQSGIPSRFSGSGSGTDFTL
TISSLEPEDFAMYYCQQHNEYPWTFGGGTKLEIKR.

In some embodiments, the anti-CD22 scFv comprises an amino acid sequence:

(SEQ ID NO: 499)
EVKLQQSGGGLVQPGGSRKLSCAASGFTFSSFGMHWVRQAPEKGLEWVAY
ISSGSSTLHYADTVKGRFTISRDNPKNTLFLQMKLPSLCYGLLGSRNLSH
RLLSQNDTPICLGGGGSGGGGSGGGGSQIVLTQSPVIMSASPGEKVTMTC
SASSSVSDMHWYQQKSGTSPKRWIYDTSKLASGVPARFSGSGSGTSYSLT
ISSMEAEDAATYYCQQWSSNPLTFGAGTKLELKR.

In some embodiments, the anti-CD22 scFv comprises an amino acid sequence:

(SEQ ID NO: 500)
EVKLQQSGGGLVQPGGSRKLSCAASGFTFSSFGMHWVRQAPEKGLEWVAY
ISSGSSTLHYADTVKGRFTISRDNPKNTLFLQMKLPSLCYGLLGSRNLSH
RLLSQNDTPICLGGGGGGGSGGGGSNIVLTQSPASLAVSLGQRATISCR
ASESVDSYGNSFMHWYQQKPGQPPKLLIYLASNLESGVPARFSGSGSRTD
FTLTIDPVEADDAATYYCQQNNEDPWTFGGGTKLEIK.

In some embodiments, the anti-CD22 scFv comprises an amino acid sequence:

(SEQ ID NO: 501)
EVKLQQSGGGLVQPGGSRKLSCAASGFTFSSFGMHWVRQAPEKGLEWVAY
ISSGSSTLHYADTVKGRFTISRDNPKNTLFLQMKLPSLCYGLLGSRNLSH
RLLSQNDTPICLGGGGSGGGGSGGGGSDVVMTQSPLSLPVSLGDQASISC
RSSQSLVHSNGNTYLHWYLQKPGQSPKLLIYKVSNRFSGVPDRFSGSGSG
TDFTLKISRVEAEDLGVYFCSQSTHVSYTFGGGTKLEIKR.

In some embodiments, the anti-CD22 scFv comprises an amino acid sequence:

(SEQ ID NO: 502)
VKLLESGGGLVQPGGSLKLSCAASGFEFSRYWMSWVRQVPGKGLEWIGEV
NPDSSTINYTTSLKDKFIISRDNAKNTLYLQMSKVRSEDTALYYCGRDSN
YGYFDVWGTGTTVTVSSGGGGSGGGGSGGGGSDVLMTQTPLSLPVSLGDQ
ASISCRSSQSIVHSNGNTYLEWYLQKPGQSPKLLIYKVSNRFSGVPDRFS
GSGSGTDFTLKISRVEAEDLGVYYCFQGSHVPPTFGGGTKLEIKR.

In some embodiments, the anti-CD22 scFv comprises an amino acid sequence:

(SEQ ID NO: 503)
VKLLESGGGLVQPGGSLKLSCAASGFEFSRYWMSWVRQVPGKGLEWIGEV
NPDSSTINYTTSLKDKFIISRDNAKNTLYLQMSKVRSEDTALYYCGRDSN
YGYFDVWGTGTTVTVSSGGGGSGGGGSGGGGSDIQMTQSPASLSASVGET
VTITCGASENIYGALNWYQRKQGKSPQLLIYGATNLADGMSSRFSGSGSG
RQYSLKISSLHPDDVATYYCQNVLSTPWTFGGGTKLEIKR.

In some embodiments, the anti-CD22 scFv comprises an amino acid sequence:

(SEQ ID NO: 504)
VKLLESGGGLVQPGGSLKLSCAASGFEFSRYWMSWVRQVPGKGLEWIGEV

NPDSSTINYTTSLKDKFIISRDNAKNTLYLQMSKVRSEDTALYYCGRDSN

YGYFDVWGTGTTVTVSSGGGGSGGGGSGGGGSDIVLTQSPASLAVSLGQR

ATISCKASQSVDYDGDSYMNWYQQKPGQPPKLLIYAASNLESGIPARFSG

SGSGTDFTLNIHPVEEEDAATYYCQQSNEDPFTFGSGTKLEIKR.

In some embodiments, the anti-CD22 scFv comprises an amino acid sequence:

(SEQ ID NO: 505)
VKLLESGGGLVQPGGSLKLSCAASGFEFSRYWMSWVRQVPGKGLEWIGEV

NPDSSTINYTTSLKDKFIISRDNAKNTLYLQMSKVRSEDTALYYCGRDSN

YGYFDVWGTGTTVTVSSGGGGSGGGGSGGGGSDIVLTQSPAIMSASPGEK

VTISCSASSSVSYMYWYQQKPGSSPKPWIYRTSNLASGVPARFSGSGSGT

SYSLTISSMEAEDAATYYCQQYHSYPYTFGGGTKLEIKR.

In some embodiments, the anti-CD22 scFv comprises an amino acid sequence:

(SEQ ID NO: 506)
VKLLESGGGLVQPGGSLKLSCAASGFEFSRYWMSWVRQVPGKGLEWIGEV

NPDSSTINYTTSLKDKFIISRDNAKNTLYLQMSKVRSEDTALYYCGRDSN

YGYFDVWGTGTTVTVSSGGGGSGGGGSGGGGSDVQITQSPSYLAASPGET

ITINCRASKSISKYLAWYQEKPGKTNKLLIYSGSTLQSGIPSRFSGSGSG

TDFTLTISSLEPEDFAMYYCQQHNEYPWTFGGGTKLEIKR.

In some embodiments, the anti-CD22 scFv comprises an amino acid sequence:

(SEQ ID NO: 507)
VKLLESGGGLVQPGGSLKLSCAASGFEFSRYWMSWVRQVPGKGLEWIGEV

NPDSSTINYTTSLKDKFIISRDNAKNTLYLQMSKVRSEDTALYYCGRDSN

YGYFDVWGTGTTVTVSSGGGGSGGGGSGGGGSQIVLTQSPVIMSASPGEK

VTMTCSASSSVSDMHWYQQKSGTSPKRWIYDTSKLASGVPARFSGSGSGT

SYSLTISSMEAEDAATYYCQQWSSNPLTFGAGTKLELKR.

In some embodiments, the anti-CD22 scFv comprises an amino acid sequence:

(SEQ ID NO: 508)
VKLLESGGGLVQPGGSLKLSCAASGFEFSRYWMSWVRQVPGKGLEWIGEV

NPDSSTINYTTSLKDKFIISRDNAKNTLYLQMSKVRSEDTALYYCGRDSN

YGYFDVWGTGTTVTVSSGGGGSGGGGSGGGGSNIVLTQSPASLAVSLGQR

ATISCRASESVDSYGNSFMHWYQQKPGQPPKLLIYLASNLESGVPARFSG

SGSRTDFTLTIDPVEADDAATYYCQQNNEDPWTFGGGTKLEIK.

In some embodiments, the anti-CD22 scFv comprises an amino acid sequence:

(SEQ ID NO: 509)
VKLLESGGGLVQPGGSLKLSCAASGFEFSRYWMSWVRQVPGKGLEWIGEV

NPDSSTINYTTSLKDKFIISRDNAKNTLYLQMSKVRSEDTALYYCGRDSN

YGYFDVWGTGTTVTVSSGGGGSGGGGSGGGGSDVVMTQSPLSLPVSLGDQ

ASISCRSSQSLVHSNGNTYLHWYLQKPGQSPKLLIYKVSNRFSGVPDRFS

GSGSGTDFTLKISRVEAEDLGVYFCSQSTHVSYTFGGGTKLEIKR.

In some embodiments, the anti-CD22 scFv comprises an amino acid sequence:

(SEQ ID NO: 510)
VQLKESGPGLVAPSQSLSITCTVSGFSLTGYGVNWVRQPPGKGLEWLGMI

WGDGSTDYNSALKSRLSISKDNSKSQVFLKMNSLQTDDTARYYCARGGYD

FDYWGQGTTLTVSSGGGGSGGGGSGGGGSDVLMTQTPLSLPVSLGDQASI

SCRSSQSIVHSNGNTYLEWYLQKPGQSPKLLIYKVSNRFSGVPDRFSGSG

SGTDFTLKISRVEAEDLGVYYCFQGSHVPPTFGGGTKLEIKR.

In some embodiments, the anti-CD22 scFv comprises an amino acid sequence:

(SEQ ID NO: 511)
VQLKESGPGLVAPSQSLSITCTVSGFSLTGYGVNWVRQPPGKGLEWLGMI

WGDGSTDYNSALKSRLSISKDNSKSQVFLKMNSLQTDDTARYYCARGGYD

FDYWGQGTTLTVSSGGGGGGGGSGGGGSDIQMTQSPASLSASVGETVTIT

CGASENIYGALNWYQRKQGKSPQLLIYGATNLADGMSSRFSGSGSGRQYS

LKISSLHPDDVATYYCQNVLSTPWTFGGGTKLEIKR.

In some embodiments, the anti-CD22 scFv comprises an amino acid sequence:

(SEQ ID NO: 512)
VQLKESGPGLVAPSQSLSITCTVSGFSLTGYGVNWVRQPPGKGLEWLGMI

WGDGSTDYNSALKSRLSISKDNSKSQVFLKMNSLQTDDTARYYCARGGYD

FDYWGQGTTLTVSSGGGGSGGGGSGGGGSDIVLTQSPASLAVSLGQRATI

SCKASQSVDYDGDSYMNWYQQKPGQPPKLLIYAASNLESGIPARFSGSGS

GTDFTLNIHPVEEEDAATYYCQQSNEDPFTFGSGTKLEIKR.

In some embodiments, the anti-CD22 scFv comprises an amino acid sequence:

(SEQ ID NO: 513)
VQLKESGPGLVAPSQSLSITCTVSGFSLTGYGVNWVRQPPGKGLEWLGMI

WGDGSTDYNSALKSRLSISKDNSKSQVFLKMNSLQTDDTARYYCARGGYD

FDYWGQGTTLTVSSGGGGSGGGGSGGGGSDIVLTQSPAIMSASPGEKVTI

SCSASSSVSYMYWYQQKPGSSPKPWIYRTSNLASGVPARFSGSGSGTSYS

LTISSMEAEDAATYYCQQYHSYPYTFGGGTKLEIKR.

In some embodiments, the anti-CD22 scFv comprises an amino acid sequence:

(SEQ ID NO: 514)
VQLKESGPGLVAPSQSLSITCTVSGFSLTGYGVNWVRQPPGKGLEWLGMI
WGDGSTDYNSALKSRLSISKDNSKSQVFLKMNSLQTDDTARYYCARGGYD
FDYWGQGTTLTVSSGGGGSGGGGSGGGGSDVQITQSPSYLAASPGETITI
NCRASKSISKYLAWYQEKPGKTNKLLIYSGSTLQSGIPSRFSGSGSGTDF
TLTISSLEPEDFAMYYCQQHNEYPWTFGGGTKLEIKR.

In some embodiments, the anti-CD22 scFv comprises an amino acid sequence:

(SEQ ID NO: 515)
VQLKESGPGLVAPSQSLSITCTVSGFSLTGYGVNWVRQPPGKGLEWLGMI
WGDGSTDYNSALKSRLSISKDNSKSQVFLKMNSLQTDDTARYYCARGGYD
FDYWGQGTTLTVSSGGGGGGGGSGGGGSQIVLTQSPVIMSASPGEKVTMT
CSASSSVSDMHWYQQKSGTSPKRWIYDTSKLASGVPARFSGSGSGTSYSL
TISSMEAEDAATYYCQQWSSNPLTFGAGTKLELKR.

In some embodiments, the anti-CD22 scFv comprises an amino acid sequence:

(SEQ ID NO: 516)
VQLKESGPGLVAPSQSLSITCTVSGFSLTGYGVNWVRQPPGKGLEWLGMI
WGDGSTDYNSALKSRLSISKDNSKSQVFLKMNSLQTDDTARYYCARGGYD
FDYWGQGTTLTVSSGGGGSGGGGGGGGSNIVLTQSPASLAVSLGQRATIS
CRASESVDSYGNSFMHWYQQKPGQPPKLLIYLASNLESGVPARFSGSGSR
TDFTLTIDPVEADDAATYYCQQNNEDPWTFGGGTKLEIK.

In some embodiments, the anti-CD22 scFv comprises an amino acid sequence:

(SEQ ID NO: 517)
VQLKESGPGLVAPSQSLSITCTVSGFSLTGYGVNWVRQPPGKGLEWLGMI
WGDGSTDYNSALKSRLSISKDNSKSQVFLKMNSLQTDDTARYYCARGGYD
FDYWGQGTTLTVSSGGGGSGGGGSGGGGSDVVMTQSPLSLPVSLGDQASI
SCRSSQSLVHSNGNTYLHWYLQKPGQSPKLLIYKVSNRFSGVPDRFSGSG
SGTDFTLKISRVEAEDLGVYFCSQSTHVSYTFGGGTKLEIKR.

In some embodiments, the anti-CD22 scFv comprises an amino acid sequence:

(SEQ ID NO: 518)
VQLQQSGAELARPGASVKMSCKASGYTFTSYWMHWVKQRPGQGLEWIGAI
YPGNSDTSYNQKFKGKAKLTAVTSASTAYMELSSLTNEDSAVYYCTRSHY
VEGYFDVWGTGTTVTVSSGGGGSGGGGSGGGGSDVLMTQTPLSLPVSLGD
QASISCRSSQSIVHSNGNTYLEWYLQKPGQSPKLLIYKVSNRFSGVPDRF
SGSGSGTDFTLKISRVEAEDLGVYYCFQGSHVPPTFGGGTKLEIKR.

In some embodiments, the anti-CD22 scFv comprises an amino acid sequence:

(SEQ ID NO: 519)
VQLQQSGAELARPGASVKMSCKASGYTFTSYWMHWVKQRPGQGLEWIGAI
YPGNSDTSYNQKFKGKAKLTAVTSASTAYMELSSLTNEDSAVYYCTRSHY
VEGYFDVWGTGTTVTVSSGGGGSGGGGSGGGGSDIQMTQSPASLSASVGE
TVTITCGASENIYGALNWYQRKQGKSPQLLIYGATNLADGMSSRFSGSGS
GRQYSLKISSLHPDDVATYYCQNVLSTPWTFGGGTKLEIKR.

In some embodiments, the anti-CD22 scFv comprises an amino acid sequence:

(SEQ ID NO: 520)
VQLQQSGAELARPGASVKMSCKASGYTFTSYWMHWVKQRPGQGLEWIGAI
YPGNSDTSYNQKFKGKAKLTAVTSASTAYMELSSLTNEDSAVYYCTRSHY
VEGYFDVWGTGTTVTVSSGGGGSGGGGSGGGGSDIVLTQSPASLAVSLGQ
RATISCKASQSVDYDGDSYMNWYQQKPGQPPKLLIYAASNLESGIPARFS
GSGSGTDFTLNIHPVEEEDAATYYCQQSNEDPFTFGSGTKLEIKR.

In some embodiments, the anti-CD22 scFv comprises an amino acid sequence:

(SEQ ID NO: 521)
VQLQQSGAELARPGASVKMSCKASGYTFTSYWMHWVKQRPGQGLEWIGAI
YPGNSDTSYNQKFKGKAKLTAVTSASTAYMELSSLTNEDSAVYYCTRSHY
VEGYFDVWGTGTTVTVSSGGGGSGGGGSGGGGSDIVLTQSPAIMSASPGE
KVTISCSASSSVSYMYWYQQKPGSSPKPWIYRTSNLASGVPARFSGSGSG
TSYSLTISSMEAEDAATYYCQQYHSYPYTFGGGTKLEIKR.

In some embodiments, the anti-CD22 scFv comprises an amino acid sequence:

(SEQ ID NO: 522)
VQLQQSGAELARPGASVKMSCKASGYTFTSYWMHWVKQRPGQGLEWIGAI
YPGNSDTSYNQKFKGKAKLTAVTSASTAYMELSSLTNEDSAVYYCTRSHY
VEGYFDVWGTGTTVTVSSGGGGSGGGGSGGGGSDVQITQSPSYLAASPGE
TITINCRASKSISKYLAWYQEKPGKTNKLLIYSGSTLQSGIPSRFSGSGS
GTDFTLTISSLEPEDFAMYYCQQHNEYPWTFGGGTKLEIKR.

In some embodiments, the anti-CD22 scFv comprises an amino acid sequence:

(SEQ ID NO: 523)
VQLQQSGAELARPGASVKMSCKASGYTFTSYWMHWVKQRPGQGLEWIGAI
YPGNSDTSYNQKFKGKAKLTAVTSASTAYMELSSLTNEDSAVYYCTRSHY
VEGYFDVWGTGTTVTVSSGGGGSGGGGSGGGGSQIVLTQSPVIMSASPGE
KVTMTCSASSSVSDMHWYQQKSGTSPKRWIYDTSKLASGVPARFSGSGSG
TSYSLTISSMEAEDAATYYCQQWSSNPLTFGAGTKLELKR.

In some embodiments, the anti-CD22 scFv comprises an amino acid sequence:

(SEQ ID NO: 524)
VQLQQSGAELARPGASVKMSCKASGYTFTSYWMHWVKQRPGQGLEWIGAI

YPGNSDTSYNQKFKGKAKLTAVTSASTAYMELSSLTNEDSAVYYCTRSHY

VEGYFDVWGTGTTVTVSSGGGGSGGGGSGGGGSNIVLTQSPASLAVSLGQ

RATISCRASESVDSYGNSFMHWYQQKPGQPPKLLIYLASNLESGVPARFS

GSGSRTDFTLTIDPVEADDAATYYCQQNNEDPWTFGGGTKLEIK.

In some embodiments, the anti-CD22 scFv comprises an amino acid sequence:

(SEQ ID NO: 525)
VQLQQSGAELARPGASVKMSCKASGYTFTSYWMHWVKQRPGQGLEWIGAI

YPGNSDTSYNQKFKGKAKLTAVTSASTAYMELSSLTNEDSAVYYCTRSHY

VEGYFDVWGTGTTVTVSSGGGGSGGGGSGGGGSDVVMTQSPLSLPVSLGD

QASISCRSSQSLVHSNGNTYLHWYLQKPGQSPKLLIYKVSNRFSGVPDRF

SGSGSGTDFTLKISRVEAEDLGVYFCSQSTHVSYTFGGGTKLEIKR.

In some embodiments, the anti-CD22 scFv comprises an amino acid sequence:

(SEQ ID NO: 526)
QVKLQQSGAELVKPGASVKISCKASGYAFSSSWMNWVKQRPGKGLEWIGQ

IYPGDGDTKYNGKFKGKATLTADKSSSTAYMQLSSLTSEDSAVYFCANSN

YPSSQSSRTYSRRDWFAYWGQGTLVTVSAGGGGSGGGGSGGGGSDVLMTQ

TPLSLPVSLGDQASISCRSSQSIVHSNGNTYLEWYLQKPGQSPKLLIYKV

SNRFSGVPDRFSGSGSGTDFTLKISRVEAEDLGVYYCFQGSHVPPTFGGG

TKLEIKR.

In some embodiments, the anti-CD22 scFv comprises an amino acid sequence:

(SEQ ID NO: 527)
QVKLQQSGAELVKPGASVKISCKASGYAFSSSWMNWVKQRPGKGLEWIGQ

IYPGDGDTKYNGKFKGKATLTADKSSSTAYMQLSSLTSEDSAVYFCANSN

YPSSQSSRTYSRRDWFAYWGQGTLVTVSAGGGGSGGGGSGGGGSDIQMTQ

SPASLSASVGETVTITCGASENIYGALNWYQRKQGKSPQLLIYGATNLAD

GMSSRFSGSGSGRQYSLKISSLHPDDVATYYCQNVLSTPWTFGGGTKLEI

KR.

In some embodiments, the anti-CD22 scFv comprises an amino acid sequence:

(SEQ ID NO: 528)
QVKLQQSGAELVKPGASVKISCKASGYAFSSSWMNWVKQRPGKGLEWIGQ

IYPGDGDTKYNGKFKGKATLTADKSSSTAYMQLSSLTSEDSAVYFCANSN

YPSSQSSRTYSRRDWFAYWGQGTLVTVSAGGGGSGGGGSGGGGSDIVLTQ

SPASLAVSLGQRATISCKASQSVDYDGDSYMNWYQQKPGQPPKLLIYAAS

NLESGIPARFSGSGSGTDFTLNIHPVEEEDAATYYCQQSNEDPFTFGSGT

KLEIKR.

In some embodiments, the anti-CD22 scFv comprises an amino acid sequence:

(SEQ ID NO: 529)
QVKLQQSGAELVKPGASVKISCKASGYAFSSSWMNWVKQRPGKGLEWIGQ

IYPGDGDTKYNGKFKGKATLTADKSSSTAYMQLSSLTSEDSAVYFCANSN

YPSSQSSRTYSRRDWFAYWGQGTLVTVSAGGGGSGGGGSGGGGSDIVLTQ

SPAIMSASPGEKVTISCSASSSVSYMYWYQQKPGSSPKPWIYRTSNLASG

VPARFSGSGSGTSYSLTISSMEAEDAATYYCQQYHSYPYTFGGGTKLEIK

R.

In some embodiments, the anti-CD22 scFv comprises an amino acid sequence:

(SEQ ID NO: 530)
QVKLQQSGAELVKPGASVKISCKASGYAFSSSWMNWVKQRPGKGLEWIGQ

IYPGDGDTKYNGKFKGKATLTADKSSSTAYMQLSSLTSEDSAVYFCANSN

YPSSQSSRTYSRRDWFAYWGQGTLVTVSAGGGGSGGGGSGGGGSDVQITQ

SPSYLAASPGETITINCRASKSISKYLAWYQEKPGKTNKLLIYSGSTLQS

GIPSRFSGSGSGTDFTLTISSLEPEDFAMYYCQQHNEYPWTFGGGTKLEI

KR.

In some embodiments, the anti-CD22 scFv comprises an amino acid sequence:

(SEQ ID NO: 531)
QVKLQQSGAELVKPGASVKISCKASGYAFSSSWMNWVKQRPGKGLEWIGQ

IYPGDGDTKYNGKFKGKATLTADKSSSTAYMQLSSLTSEDSAVYFCANSN

YPSSQSSRTYSRRDWFAYWGQGTLVTVSAGGGGSGGGGSGGGGSQIVLTQ

SPVIMSASPGEKVTMTCSASSSVSDMHWYQQKSGTSPKRWIYDTSKLASG

VPARFSGSGSGTSYSLTISSMEAEDAATYYCQQWSSNPLTFGAGTKLELK

R.

In some embodiments, the anti-CD22 scFv comprises an amino acid sequence:

(SEQ ID NO: 532)
QVKLQQSGAELVKPGASVKISCKASGYAFSSSWMNWVKQRPGKGLEWIGQ

IYPGDGDTKYNGKFKGKATLTADKSSSTAYMQLSSLTSEDSAVYFCANSN

YPSSQSSRTYSRRDWFAYWGQGTLVTVSAGGGGSGGGGSGGGGSNIVLTQ

SPASLAVSLGQRATISCRASESVDSYGNSFMHWYQQKPGQPPKLLIYLAS

NLESGVPARFSGSGSRTDFTLTIDPVEADDAATYYCQQNNEDPWTFGGGT

KLEIK.

In some embodiments, the anti-CD22 scFv comprises an amino acid sequence:

(SEQ ID NO: 533)
QVKLQQSGAELVKPGASVKISCKASGYAFSSSWMNWVKQRPGKGLEWIGQ

IYPGDGDTKYNGKFKGKATLTADKSSSTAYMQLSSLTSEDSAVYFCANSN

YPSSQSSRTYSRRDWFAYWGQGTLVTVSAGGGGSGGGGSGGGGSDVVMTQ

SPLSLPVSLGDQASISCRSSQSLVHSNGNTYLHWYLQKPGQSPKLLIYKV

SNRFSGVPDRFSGSGSGTDFTLKISRVEAEDLGVYFCSQSTHVSYTFGGG

TKLEIKR.

In some embodiments, the anti-CD22 scFv comprises an amino acid sequence:

(SEQ ID NO: 534)
DVKLQESGGGLVKPGGSLKLSCAVSGFTFSSFAMSWVRQTPEKRLEWVAT

ISSGGAYTFYKDSVKGRFTISRDNAKNTLYLQMSSLRSEDSAMYYCARHS

GYDGYYLYAMDCWGQGTSVTVSSGGGGSGGGGSGGGGSDVLMTQTPLSLP

VSLGDQASISCRSSQSIVHSNGNTYLEWYLQKPGQSPKLLIYKVSNRFSG

VPDRFSGSGSGTDFTLKISRVEAEDLGVYYCFQGSHVPPTFGGGTKLEIK

R.

In some embodiments, the anti-CD22 scFv comprises an amino acid sequence:

(SEQ ID NO:535)
DVKLQESGGGLVKPGGSLKLSCAVSGFTFSSFAMSWVRQTPEKRLEWVAT

ISSGGAYTFYKDSVKGRFTISRDNAKNTLYLQMSSLRSEDSAMYYCARHS

GYDGYYLYAMDCWGQGTSVTVSSGGGGSGGGGSGGGGSDIQMTQSPASLS

ASVGETVTITCGASENIYGALNWYQRKQGKSPQLLIYGATNLADGMSSRF

SGSGSGRQYSLKISSLHPDDVATYYCQNVLSTPWTFGGGTKLEIKR.

In some embodiments, the anti-CD22 scFv comprises an amino acid sequence:

(SEQ ID NO: 536)
DVKLQESGGGLVKPGGSLKLSCAVSGFTFSSFAMSWVRQTPEKRLEWVAT

ISSGGAYTFYKDSVKGRFTISRDNAKNTLYLQMSSLRSEDSAMYYCARHS

GYDGYYLYAMDCWGQGTSVTVSSGGGGGGGGSGGGGSDIVLTQSPASLAV

SLGQRATISCKASQSVDYDGDSYMNWYQQKPGQPPKLLIYAASNLESGIP

ARFSGSGSGTDFTLNIHPVEEEDAATYYCQQSNEDPFTFGSGTKLEIKR.

In some embodiments, the anti-CD22 scFv comprises an amino acid sequence:

(SEQ ID NO: 537)
DVKLQESGGGLVKPGGSLKLSCAVSGFTFSSFAMSWVRQTPEKRLEWVAT

ISSGGAYTFYKDSVKGRFTISRDNAKNTLYLQMSSLRSEDSAMYYCARHS

GYDGYYLYAMDCWGQGTSVTVSSGGGGSGGGGSGGGGSDIVLTQSPAIMS

ASPGEKVTISCSASSSVSYMYWYQQKPGSSPKPWIYRTSNLASGVPARFS

GSGSGTSYSLTISSMEAEDAATYYCQQYHSYPYTFGGGTKLEIKR.

In some embodiments, the anti-CD22 scFv comprises an amino acid sequence:

(SEQ ID NO: 538)
DVKLQESGGGLVKPGGSLKLSCAVSGFTFSSFAMSWVRQTPEKRLEWVAT

ISSGGAYTFYKDSVKGRFTISRDNAKNTLYLQMSSLRSEDSAMYYCARHS

GYDGYYLYAMDCWGQGTSVTVSSGGGGSGGGGSGGGGSDVQITQSPSYLA

ASPGETITINCRASKSISKYLAWYQEKPGKTNKLLIYSGSTLQSGIPSRF

SGSGSGTDFTLTISSLEPEDFAMYYCQQHNEYPWTFGGGTKLEIKR.

In some embodiments, the anti-CD22 scFv comprises an amino acid sequence:

(SEQ ID NO: 539)
DVKLQESGGGLVKPGGSLKLSCAVSGFTFSSFAMSWVRQTPEKRLEWVA

TISSGGAYTFYKDSVKGRFTISRDNAKNTLYLQMSSLRSEDSAMYYCAR

HSGYDGYYLYAMDCWGQGTSVTVSSGGGGSGGGGSGGGGSQIVLTQSPV

IMSASPGEKVTMTCSASSSVSDMHWYQQKSGTSPKRWIYDTSKLASGVP

ARFSGSGSGTSYSLTISSMEAEDAATYYCQQWSSNPLTFGAGTKLELKR.

In some embodiments, the anti-CD22 scFv comprises an amino acid sequence:

(SEQ ID NO: 540)
DVKLQESGGGLVKPGGSLKLSCAVSGFTFSSFAMSWVRQTPEKRLEWVA

TISSGGAYTFYKDSVKGRFTISRDNAKNTLYLQMSSLRSEDSAMYYCAR

HSGYDGYYLYAMDCWGQGTSVTVSSGGGGSGGGGSGGGGSNIVLTQSPA

SLAVSLGQRATISCRASESVDSYGNSFMHWYQQKPGQPPKLLIYLASNL

ESGVPARFSGSGSRTDFTLTIDPVEADDAATYYCQQNNEDPWTFGGGTK

LEIK.

In some embodiments, the anti-CD22 scFv comprises an amino acid sequence:

(SEQ ID NO: 541)
DVKLQESGGGLVKPGGSLKLSCAVSGFTFSSFAMSWVRQTPEKRLEWVA

TISSGGAYTFYKDSVKGRFTISRDNAKNTLYLQMSSLRSEDSAMYYCAR

HSGYDGYYLYAMDCWGQGTSVTVSSGGGGSGGGGSGGGGSDVVMTQSPL

SLPVSLGDQASISCRSSQSLVHSNGNTYLHWYLQKPGQSPKLLIYKVSN

RFSGVPDRFSGSGSGTDFTLKISRVEAEDLGVYFCSQSTHVSYTFGGGT

KLEIKR.

In some embodiments, the anti-CD22 scFv comprises an amino acid sequence:

(SEQ ID NO: 542)
EVKLQQSGGGLVKPGASLKLSCAASGFTFSNYGMSWVRQTSDKRLEWVA

SISSGGGRIYYPDNVKGRFTISRENAKNTLYLQMNSLKSDDTALYYCAR

EPPNYYGGTYGDYWGQGTTLTVSSGGGGSGGGGSGGGGSDVLMTQTPLS

LPVSLGDQASISCRSSQSIVHSNGNTYLEWYLQKPGQSPKLLIYKVSNR

FSGVPDRFSGSGSGTDFTLKISRVEAEDLGVYYCFQGSHVPPTFGGGTK
LEIKR.

In some embodiments, the anti-CD22 scFv comprises an amino acid sequence:

(SEQ ID NO: 543)
EVKLQQSGGGLVKPGASLKLSCAASGFTFSNYGMSWVRQTSDKRLEWVA

SISSGGGRIYYPDNVKGRFTISRENAKNTLYLQMNSLKSDDTALYYCAR

EPPNYYGGTYGDYWGQGTTLTVSSGGGGSGGGGSGGGGSDIQMTQSPAS

LSASVGETVTITCGASENIYGALNWYQRKQGKSPQLLIYGATNLADGMS

SRFSGSGSGRQYSLKISSLHPDDVATYYCQNVLSTPWTFGGGTKLEIKR.

In some embodiments, the anti-CD22 scFv comprises an amino acid sequence:

(SEQ ID NO: 544)
EVKLQQSGGGLVKPGASLKLSCAASGFTFSNYGMSWVRQTSDKRLEWVA

SISSGGGRIYYPDNVKGRFTISRENAKNTLYLQMNSLKSDDTALYYCAR

EPPNYYGGTYGDYWGQGTTLTVSSGGGGSGGGGSGGGGSDIVLTQSPAS

LAVSLGQRATISCKASQSVDYDGDSYMNWYQQKPGQPPKLLIYAASNLE

SGIPARFSGSGSGTDFTLNIHPVEEEDAATYYCQQSNEDPFTFGSGTKL

EIKR.

In some embodiments, the anti-CD22 scFv comprises an amino acid sequence:

(SEQ ID NO: 545)
EVKLQQSGGGLVKPGASLKLSCAASGFTFSNYGMSWVRQTSDKRLEWVA

SISSGGGRIYYPDNVKGRFTISRENAKNTLYLQMNSLKSDDTALYYCAR

EPPNYYGGTYGDYWGQGTTLTVSSGGGGSGGGGSGGGGSDIVLTQSPAI

MSASPGEKVTISCSASSSVSYMYWYQQKPGSSPKPWIYRTSNLASGVPA

RFSGSGSGTSYSLTISSMEAEDAATYYCQQYHSYPYTFGGGTKLEIKR.

In some embodiments, the anti-CD22 scFv comprises an amino acid sequence:

(SEQ ID NO: 546)
EVKLQQSGGGLVKPGASLKLSCAASGFTFSNYGMSWVRQTSDKRLEWVA

SISSGGGRIYYPDNVKGRFTISRENAKNTLYLQMNSLKSDDTALYYCAR

EPPNYYGGTYGDYWGQGTTLTVSSGGGGSGGGGSGGGGSDVQITQSPSY

LAASPGETITINCRASKSISKYLAWYQEKPGKTNKLLIYSGSTLQSGIP

SRFSGSGSGTDFTLTISSLEPEDFAMYYCQQHNEYPWTFGGGTKLEIKR.

In some embodiments, the anti-CD22 scFv comprises an amino acid sequence:

(SEQ ID NO: 547)
EVKLQQSGGGLVKPGASLKLSCAASGFTFSNYGMSWVRQTSDKRLEWVA

SISSGGGRIYYPDNVKGRFTISRENAKNTLYLQMNSLKSDDTALYYCAR

EPPNYYGGTYGDYWGQGTTLTVSSGGGGSGGGGSGGGGSQIVLTQSPVI

MSASPGEKVTMTCSASSSVSDMHWYQQKSGTSPKRWIYDTSKLASGVPA

RFSGSGSGTSYSLTISSMEAEDAATYYCQQWSSNPLTFGAGTKLELKR.

In some embodiments, the anti-CD22 scFv comprises an amino acid sequence:

(SEQ ID NO: 548)
EVKLQQSGGGLVKPGASLKLSCAASGFTFSNYGMSWVRQTSDKRLEWVA

SISSGGGRIYYPDNVKGRFTISRENAKNTLYLQMNSLKSDDTALYYCAR

EPPNYYGGTYGDYWGQGTTLTVSSGGGGSGGGGSGGGGSNIVLTQSPAS

LAVSLGQRATISCRASESVDSYGNSFMHWYQQKPGQPPKLLIYLASNLE

SGVPARFSGSGSRTDFTLTIDPVEADDAATYYCQQNNEDPWTFGGGTKL

EIK.

In some embodiments, the anti-CD22 scFv comprises an amino acid sequence:

(SEQ ID NO: 549)
EVKLQQSGGGLVKPGASLKLSCAASGFTFSNYGMSWVRQTSDKRLEWVA

SISSGGGRIYYPDNVKGRFTISRENAKNTLYLQMNSLKSDDTALYYCAR

EPPNYYGGTYGDYWGQGTTLTVSSGGGGSGGGGSGGGGSDVVMTQSPLS

LPVSLGDQASISCRSSQSLVHSNGNTYLHWYLQKPGQSPKLLIYKVSNR

FSGVPDRFSGSGSGTDFTLKISRVEAEDLGVYFCSQSTHVSYTFGGGTK

LEIKR.

In some embodiments, the anti-CD22 scFv comprises an amino acid sequence:

(SEQ ID NO: 550)
DVLMTQTPLSLPVSLGDQASISCRSSQSIVHSNGNTYLEWYLQKPGQSP

KLLIYKVSNRFSGVPDRFSGSGSGTDFTLKISRVEAEDLGVYYCFQGSH

VPPTFGGGTKLEIKRGGGGSGGGGSGGGGSQVKLQQSGAELGKPGTSVK

LSCKASGYTFTSYWMHWVKQRPGQGLEWIGNINPNSGSTNYNEKFKSKA

TLTVDKSSSTAYMQLSTLTSEDSAVYYCTRPGVWGTGTTVTVSS.

In some embodiments, the anti-CD22 scFv comprises an amino acid sequence:

(SEQ ID NO: 551)
DVLMTQTPLSLPVSLGDQASISCRSSQSIVHSNGNTYLEWYLQKPGQSP

KLLIYKVSNRFSGVPDRFSGSGSGTDFTLKISRVEAEDLGVYYCFQGSH

VPPTFGGGTKLEIKRGGGGSGGGGSGGGGSEVKLQQSGGGLVQPGGSRK

LSCAASGFTFSSFGMHWVRQAPEKGLEWAYISSGSSTLHYADTVKGRFT

ISRDNPKNTLFLQMKLPSLCYGLLGSRNLSHRLLSQNDTPICL.

In some embodiments, the anti-CD22 scFv comprises an amino acid sequence:

(SEQ ID NO: 552)
DVLMTQTPLSLPVSLGDQASISCRSSQSIVHSNGNTYLEWYLQKPGQSP

KLLIYKVSNRFSGVPDRFSGSGSGTDFTLKISRVEAEDLGVYYCFQGSH

VPPTFGGGTKLEIKRGGGGSGGGGSGGGGSVKLLESGGGLVQPGGSLKL

SCAASGFEFSRYWMSWVRQVPGKGLEWIGEVNPDSSTINYTTSLKDKFI

ISRDNAKNTLYLQMSKVRSEDTALYYCGRDSNYGYFDVWGTGTTVTVSS.

In some embodiments, the anti-CD22 scFv comprises an amino acid sequence:

(SEQ ID NO: 553)
DVLMTQTPLSLPVSLGDQASISCRSSQSIVHSNGNTYLEWYLQKPGQSP

KLLIYKVSNRFSGVPDRFSGSGSGTDFTLKISRVEAEDLGVYYCFQGSH

VPPTFGGGTKLEIKRGGGGSGGGGSGGGGSVQLKESGPGLVAPSQSLSI

TCTVSGFSLTGYGVNWVRQPPGKGLEWLGMIWGDGSTDYNSALKSRLSI

SKDNSKSQVFLKMNSLQTDDTARYYCARGGYDFDYWGQGTTLTVSS.

In some embodiments, the anti-CD22 scFv comprises an amino acid sequence:

(SEQ ID NO: 554)
DVLMTQTPLSLPVSLGDQASISCRSSQSIVHSNGNTYLEWYLQKPGQSP

KLLIYKVSNRFSGVPDRFSGSGSGTDFTLKISRVEAEDLGVYYCFQGSH

VPPTFGGGTKLEIKRGGGGSGGGGSGGGGSVQLQQSGAELARPGASVKM

SCKASGYTFTSYWMHWVKQRPGQGLEWIGAIYPGNSDTSYNQKFKGKAK

LTAVTSASTAYMELSSLTNEDSAVYYCTRSHYVEGYFDVWGTGTTVTVS

S.

In some embodiments, the anti-CD22 scFv comprises an amino acid sequence:

(SEQ ID NO: 555)
DVLMTQTPLSLPVSLGDQASISCRSSQSIVHSNGNTYLEWYLQKPGQSP

KLLIYKVSNRFSGVPDRFSGSGSGTDFTLKISRVEAEDLGVYYCFQGSH

VPPTFGGGTKLEIKRGGGGSGGGGSGGGGSQVKLQQSGAELVKPGASVK

ISCKASGYAFSSSWMNWVKQRPGKGLEWIGQIYPGDGDTKYNGKFKGKA

TLTADKSSSTAYMQLSSLTSEDSAVYFCANSNYPSSQSSRTYSRRDWFA

YWGQGTLVTVSA.

In some embodiments, the anti-CD22 scFv comprises an amino acid sequence:

(SEQ ID NO: 556)
DVLMTQTPLSLPVSLGDQASISCRSSQSIVHSNGNTYLEWYLQKPGQSP

KLLIYKVSNRFSGVPDRFSGSGSGTDFTLKISRVEAEDLGVYYCFQGSH

VPPTFGGGTKLEIKRGGGGSGGGGSGGGGSDVKLQESGGGLVKPGGSLK

LSCAVSGFTSSFAMSWVRQTPEKRLEWVATISSGGAYTFYKDSVKGRF

TISRDNAKNTLYLQMSSLRSEDSAMYYCARHSGYDGYYLYAMDCWGQGT

SVTVSS.

In some embodiments, the anti-CD22 scFv comprises an amino acid sequence:

(SEQ ID NO: 557)
DVLMTQTPLSLPVSLGDQASISCRSSQSIVHSNGNTYLEWYLQKPGQSP

KLLIYKVSNRFSGVPDRFSGSGSGTDFTLKISRVEAEDLGVYYCFQGSH

VPPTFGGGTKLEIKRGGGGSGGGGSGGGGSEVKLQQSGGGLVKPGASLK

LSCAASGFTFSNYGMSWVRQTSDKRLEWVASISSGGGRIYYPDNVKGRF

TISRENAKNTLYLQMNSLKSDDTALYYCAREPPNYYGGTYGDYWGQGTT

LTVSS.

In some embodiments, the anti-CD22 scFv comprises an amino acid sequence:

(SEQ ID NO: 558)
DIQMTQSPASLSASVGETVTITCGASENIYGALNWYQRKQGKSPQLLIY

GATNLADGMSSRFSGSGSGRQYSLKISSLHPDDVATYYCQNVLSTPWTF

GGGTKLEIKRGGGGSGGGGSGGGGSQVKLQQSGAELGKPGTSVKLSCKA

SGYTFTSYWMHWVKQRPGQGLEWIGNINPNSGSTNYNEKFKSKATLTVD

KSSSTAYMQLSTLTSEDSAVYYCTRPGVWGTGTTVTVSS.

In some embodiments, the anti-CD22 scFv comprises an amino acid sequence:

(SEQ ID NO: 559)
DIQMTQSPASLSASVGETVTITCGASENIYGALNWYQRKQGKSPQLLIY

GATNLADGMSSRFSGSGSGRQYSLKISSLHPDDVATYYCQNVLSTPWTF

GGGTKLEIKRGGGGSGGGGSGGGGSEVKLQQSGGGLVQPGGSRKLSCAA

SGFTFSSFGMHWVRQAPEKGLEWVAYISSGSSTLHYADTVKGRFTISRD

NPKNTLFLQMKLPSLCYGLLGSRNLSHRLLSQNDTPICL.

In some embodiments, the anti-CD22 scFv comprises an amino acid sequence:

(SEQ ID NO: 560)
DIQMTQSPASLSASVGETVTITCGASENIYGALNWYQRKQGKSPQLLIY

GATNLADGMSSRFSGSGSGRQYSLKISSLHPDDVATYYCQNVLSTPWTF

GGGTKLEIKRGGGGSGGGGSGGGGSVKLLESGGGLVQPGGSLKLSCAAS

GFEFSRYWMSWVRQVPGKGLEWIGEVNPDSSTINYTTSLKDKFIISRDN

AKNTLYLQMSKVRSEDTALYYCGRDSNYGYFDVWGTGTTVTVSS.

In some embodiments, the anti-CD22 scFv comprises an amino acid sequence:

(SEQ ID NO: 561)
DIQMTQSPASLSASVGETVTITCGASENIYGALNWYQRKQGKSPQLLIY

GATNLADGMSSRFSGSGSGRQYSLKISSLHPDDVATYYCQNVLSTPWTF

GGGTKLEIKRGGGGSGGGGSGGGGSVQLKESGPGLVAPSQSLSITCTVS

GFSLTGYGVNWVRQPPGKGLEWLGMIWGDGSTDYNSALKSRLSISKDNS

KSQVFLKMNSLQTDDTARYYCARGGYDFDYWGQGTTLTVSS.

In some embodiments, the anti-CD22 scFv comprises an amino acid sequence:

(SEQ ID NO: 562)
DIQMTQSPASLSASVGETVTITCGASENIYGALNWYQRKQGKSPQLLIY
GATNLADGMSSRFSGSGSGRQYSLKISSLHPDDVATYYCQNVLSTPWTF
GGGTKLEIKRGGGGSGGGGSGGGGSVQLQQSGAELARPGASVKMSCKAS
GYTFTSYWMHWVKQRPGQGLEWIGAIYPGNSDTSYNQKFKGKAKLTAVT
SASTAYMELSSLTNEDSAVYYCTRSHYVEGYFDVWGTGTTVTVSS.

In some embodiments, the anti-CD22 scFv comprises an amino acid sequence:

(SEQ ID NO: 563)
DIQMTQSPASLSASVGETVTITCGASENIYGALNWYQRKQGKSPQLLIY
GATNLADGMSSRFSGSGSGRQYSLKISSLHPDDVATYYCQNVLSTPWTF
GGGTKLEIKRGGGGSGGGGSGGGGSQVKLQQSGAELVKPGASVKISCKA
SGYAFSSSWMNWVKQRPGKGLEWIGQIYPGDGDTKYNGKFKGKATLTAD
KSSSTAYMQLSSLTSEDSAVYFCANSNYPSSQSSRTYSRRDWFAYWGQG
TLVTVSA.

In some embodiments, the anti-CD22 scFv comprises an amino acid sequence:

(SEQ ID NO: 564)
DIQMTQSPASLSASVGETVTITCGASENIYGALNWYQRKQGKSPQLLIY
GATNLADGMSSRFSGSGSGRQYSLKISSLHPDDVATYYCQNVLSTPWTF
GGGTKLEIKRGGGGSGGGGSGGGGSDVKLQESGGGLVKPGGSLKLSCAV
SGFTFSSFAMSWVRQTPEKRLEWVATISSGGAYTFYKDSVKGRFTISRD
NAKNTLYLQMSSLRSEDSAMYYCARHSGYDGYYLYAMDCWGQGTSVTVS
S.

In some embodiments, the anti-CD22 scFv comprises an amino acid sequence:

(SEQ ID NO:565)
DIQMTQSPASLSASVGETVTITCGASENIYGALNWYQRKQGKSPQLLIY
GATNLADGMSSRFSGSGSGRQYSLKISSLHPDDVATYYCQNVLSTPWTF
GGGTKLEIKRGGGGSGGGGSGGGGSEVKLQQSGGGLVKPGASLKLSCAA
SGFTFSNYGMSWVRQTSDKRLEWVASISSGGGRIYYPDNVKGRFTISRE
NAKNTLYLQMNSLKSDDTALYYCAREPPNYYGGTYGDYWGQGTTLTVSS.

In some embodiments, the anti-CD22 scFv comprises an amino acid sequence:

(SEQ ID NO: 566)
DIVLTQSPASLAVSLGQRATISCKASQSVDYDGDSYMNWYQQKPGQPPK
LLIYAASNLESGIPARFSGSGSGTDFTLNIHPVEEEDAATYYCQQSNED
PFTFGSGTKLEIKRGGGGSGGGGSGGGGSQVKLQQSGAELGKPGTSVKL
SCKASGYTFTSYWMHWVKQRPGQGLEWIGNINPNSGSTNYNEKFKSKAT
LTVDKSSSTAYMQLSTLTSEDSAVYYCTRPGVWGTGTTVTVSS.

In some embodiments, the anti-CD22 scFv comprises an amino acid sequence:

(SEQ ID NO: 567)
DIVLTQSPASLAVSLGQRATISCKASQSVDYDGDSYMNWYQQKPGQPPK
LLIYAASNLESGIPARFSGSGSGTDFTLNIHPVEEEDAATYYCQQSNED
PFTFGSGTKLEIKRGGGGSGGGGSGGGGSEVKLQQSGGGLVQPGGSRKL
SCAASGFTFSSFGMHWVRQAPEKGLEWVAYISSGSSTLHYADTVKGRFT
ISRDNPKNTLFLQMKLPSLCYGLLGSRNLSHRLLSQNDTPICL.

In some embodiments, the anti-CD22 scFv comprises an amino acid sequence:

(SEQ ID NO: 568)
DIVLTQSPASLAVSLGQRATISCKASQSVDYDGDSYMNWYQQKPGOPPK
LLIYAASNLESGIPARFSGSGSGTDFTLNIHPVEEEDAATYYCQQSNED
PFTFGSGTKLEIKRGGGGSGGGGSGGGGSVKLLESGGGLVQPGGSLKLS
CAASGFEFSRYWMSWVRQVPGKGLEWIGEVNPDSSTINYTTSLKDKFII
SRDNAKNTLYLQMSKVRSEDTALYYCGRDSNYGYFDVWGTGTTVTVSS.

In some embodiments, the anti-CD22 scFv comprises an amino acid sequence:

(SEQ ID NO: 569)
DIVLTQSPASLAVSLGQRATISCKASQSVDYDGDSYMNWYQQKPGQPPK
LLIYAASNLESGIPARFSGSGSGTDFTLNIHPVEEEDAATYYCQQSNED
PFTFGSGTKLEIKRGGGGSGGGGSGGGGSVQLKESGPGLVAPSQSLSIT
CTVSGFSLTGYGVNWVRQPPGKGLEWLGMIWGDGSTDYNSALKSRLSIS
KDNSKSQVFLKMNSLQTDDTARYYCARGGYDFDYWGQGTTLTVSS.

In some embodiments, the anti-CD22 scFv comprises an amino acid sequence:

(SEQ ID NO: 570)
DIVLTQSPASLAVSLGQRATISCKASQSVDYDGDSYMNWYQQKPGQPPK
LLIYAASNLESGIPARFSGSGSGTDFTLNIHPVEEEDAATYYCQQSNED
PFTFGSGTKLEIKRGGGGSGGGGSGGGGSVQLQQSGAELARPGASVKMS
CKASGYTFTSYWMHWVKQRPGQGLEWIGAIYPGNSDTSYNQKFKGKAKL
TAVTSASTAYMELSSLTNEDSAVYYCTRSHYVEGYFDVWGTGTTVTVSS.

In some embodiments, the anti-CD22 scFv comprises an amino acid sequence:

(SEQ ID NO: 571)
DIVLTQSPASLAVSLGQRATISCKASQSVDYDGDSYMNWYQQKPGQPPK
LLIYAASNLESGIPARFSGSGSGTDFTLNIHPVEEEDAATYYCQQSNED
PFTFGSGTKLEIKRGGGGSGGGGGGGSQVKLQQSGAELVKPGASVKIS
CKASGYAFSSSWMNWVKQRPGKGLEWIGQIYPGDGDTKYNGKFKGKATL
TADKSSSTAYMQLSSLTSEDSAVYFCANSNYPSSQSSRTYSRRDWFAYW
GQGTLVTVSA.

In some embodiments, the anti-CD22 scFv comprises an amino acid sequence:

(SEQ ID NO: 572)
DIVLTQSPASLAVSLGQRATISCKASQSVDYDGDSYMNWYQQKPGQPPK
LLIYAASNLESGIPARFSGSGSGTDFTLNIHPVEEEDAATYYCQQSNED
PFTFGSGTKLEIKRGGGGSGGGGSGGGGSDVKLQESGGGLVKPGGSLKL
SCAVSGFTFSSFAMSWVRQTPEKRLEWVATISSGGAYTFYKDSVKGRFT
ISRDNAKNTLYLQMSSLRSEDSAMYYCARHSGYDGYYLYAMDCWGQGTS
VTVSS.

In some embodiments, the anti-CD22 scFv comprises an amino acid sequence:

(SEQ ID NO: 573)
DIVLTQSPASLAVSLGQRATISCKASQSVDYDGDSYMNWYQQKPGQPPK
LLIYAASNLESGIPARFSGSGSGTDFTLNIHPVEEEDAATYYCQQSNED
PFTFGSGTKLEIKRGGGGSGGGGSGGGGSEVKLQQSGGGLVKPGASLKL
SCAASGFTFSNYGMSWVRQTSDKRLEWVASISSGGGRIYYPDNVKGRFT
ISRENAKNTLYLQMNSLKSDDTALYYCAREPPNYYGGTYGDYWGQGTTL
TVSS.

In some embodiments, the anti-CD22 scFv comprises an amino acid sequence:

(SEQ ID NO: 574)
DIVLTQSPAIMSASPGEKVTISCSASSSVSYMYWYQQKPGSSPKPWIYR
TSNLASGVPARFSGSGSGTSYSLTISSMEAEDAATYYCQQYHSYPYTFG
GGTKLEIKRGGGGSGGGGSGGGGSQVKLQQSGAELGKPGTSVKLSCKAS
GYTFTSYWMHWVKQRPGQGLEWIGNINPNSGSTNYNEKFKSKATLTVDK
SSSTAYMQLSTLTSEDSAVYYCTRPGVWGTGTTVTVSS.

In some embodiments, the anti-CD22 scFv comprises an amino acid sequence:

(SEQ ID NO: 575)
DIVLTQSPAIMSASPGEKVTISCSASSSVSYMYWYQQKPGSSPKPWIYR
TSNLASGVPARFSGSGSGTSYSLTISSMEAEDAATYYCQQYHSYPYTFG
GGTKLEIKRGGGGSGGGGSGGGGSEVKLQQSGGGLVQPGGSRKLSCAAS
GFTFSSFGMHWVRQAPEKGLEWVAYISSGSSTLHYADTVKGRFTISRDN
PKNTLFLQMKLPSLCYGLLGSRNLSHRLLSQNDTPICL.

In some embodiments, the anti-CD22 scFv comprises an amino acid sequence:

(SEQ ID NO: 576)
DIVLTQSPAIMSASPGEKVTISCSASSSVSYMYWYQQKPGSSPKPWIYR
TSNLASGVPARFSGSGSGTSYSLTISSMEAEDAATYYCQQYHSYPYTFG
GGTKLEIKRGGGGSGGGGSGGGGSVKLLESGGGLVQPGGSLKLSCAASG
FEFSRYWMSWVRQVPGKGLEWIGEVNPDSSTINYTTSLKDKFIISRDNA
KNTLYLQMSKVRSEDTALYYCGRDSNYGYFDVWGTGTTVTVSS.

In some embodiments, the anti-CD22 scFv comprises an amino acid sequence:

(SEQ ID NO: 577)
DIVLTQSPAIMSASPGEKVTISCSASSSVSYMYWYQQKPGSSPKPWIYR
TSNLASGVPARFSGSGSGTSYSLTISSMEAEDAATYYCQQYHSYPYTFG
GGTKLEIKRGGGGSGGGGSGGGGSVQLKESGPGLVAPSQSLSITCTVSG
FSLTGYGVNWVRQPPGKGLEWLGMIWGDGSTDYNSALKSRLSISKDNSK
SQVFLKMNSLQTDDTARYYCARGGYDFDYWGQGTTLTVSS.

In some embodiments, the anti-CD22 scFv comprises an amino acid sequence:

(SEQ ID NO: 578)
DIVLTQSPAIMSASPGEKVTISCSASSSVSYMYWYQQKPGSSPKPWIYR
TSNLASGVPARFSGSGSGTSYSLTISSMEAEDAATYYCQQYHSYPYTFG
GGTKLEIKRGGGGSGGGGSGGGGSVQLQQSGAELARPGASVKMSCKASG
YTFTSYWMHWVKQRPGQGLEWIGAIYPGNSDTSYNQKFKGKAKLTAVTS
ASTAYMELSSLTNEDSAVYYCTRSHYVEGYFDVWGTGTTVTVSS.

In some embodiments, the anti-CD22 scFv comprises an amino acid sequence:

(SEQ ID NO: 579)
DIVLTQSPAIMSASPGEKVTISCSASSSVSYMYWYQQKPGSSPKPWIYR
TSNLASGVPARFSGSGSGTSYSLTISSMEAEDAATYYCQQYHSYPYTFG
GGTKLEIKRGGGGSGGGGSGGGGSQVKLQQSGAELVKPGASVKISCKAS
GYAFSSSWMNWVKQRPGKGLEWIGQIYPGDGDTKYNGKFKGKATLTADK
SSSTAYMQLSSLTSEDSAVYFCANSNYPSSQSSRTYSRRDWFAYWGQGT
LVTVSA.

In some embodiments, the anti-CD22 scFv comprises an amino acid sequence:

(SEQ ID NO: 580)
DIVLTQSPAIMSASPGEKVTISCSASSSVSYMYWYQQKPGSSPKPWIYR
TSNLASGVPARFSGSGSGTSYSLTISSMEAEDAATYYCQQYHSYPYTFG
GGTKLEIKRGGGGSGGGGSGGGGSDVKLQESGGGLVKPGGSLKLSCAVS
GFTFSSFAMSWVRQTPEKRLEWVATISSGGAYTFYKDSVKGRFTISRDN
AKNTLYLQMSSLRSEDSAMYYCARHSGYDGYYLYAMDCWGQGTSVTVSS.

In some embodiments, the anti-CD22 scFv comprises an amino acid sequence:

(SEQ ID NO: 581)
DIVLTQSPAIMSASPGEKVTISCSASSSVSYMYWYQQKPGSSPKPWIYR
TSNLASGVPARFSGSGSGTSYSLTISSMEAEDAATYYCQQYHSYPYTFG
GGTKLEIKRGGGGSGGGGSGGGGSEVKLQQSGGGLVKPGASLKLSCAAS
GFTFSNYGMSWVRQTSDKRLEWVASISSGGGRIYYPDNVKGRFTISREN
AKNTLYLQMNSLKSDDTALYYCAREPPNYYGGTYGDYWGQGTTLTVSS.

In some embodiments, the anti-CD22 scFv comprises an amino acid sequence:

(SEQ ID NO: 582)
DVQITQSPSYLAASPGETITINCRASKSISKYLAWYQEKPGKTNKLLIY

SGSTLQSGIPSRFSGSGSGTDFTLTISSLEPEDFAMYYCQQHNEYPWTF

GGGTKLEIKRGGGGSGGGGSGGGGSQVKLQQSGAELGKPGTSVKLSCKA

SGYTFTSYWMHWVKQRPGQGLEWIGNINPNSGSTNYNEKFKSKATLTVD

KSSSTAYMQLSTLTSEDSAVYYCTRPGVWGTGTTVTVSS.

In some embodiments, the anti-CD22 scFv comprises an amino acid sequence:

(SEQ ID NO: 583)
DVQITQSPSYLAASPGETITINCRASKSISKYLAWYQEKPGKTNKLLIY

SGSTLQSGIPSRFSGSGSGTDFTLTISSLEPEDFAMYYCQQHNEYPWTF

GGGTKLEIKRGGGGSGGGGSGGGGSEVKLQQSGGGLVQPGGSRKLSCAA

SGFTFSSFGMHWVRQAPEKGLEWVAYISSGSSTLHYADTVKGRFTISRD

NPKNTLFLQMKLPSLCYGLLGSRNLSHRLLSQNDTPICL.

In some embodiments, the anti-CD22 scFv comprises an amino acid sequence:

(SEQ ID NO: 584)
DVQITQSPSYLAASPGETITINCRASKSISKYLAWYQEKPGKTNKLLIY

SGSTLQSGIPSRFSGSGSGTDFTLTISSLEPEDFAMYYCQQHNEYPWTF

GGGTKLEIKRGGGGSGGGGSGGGGSVKLLESGGGLVQPGGSLKLSCAAS

GFEFSRYWMSWVRQVPGKGLEWIGEVNPDSSTINYTTSLKDKFIISRDN

AKNTLYLQMSKVRSEDTALYYCGRDSNYGYFDVWGTGTTVTVSS.

In some embodiments, the anti-CD22 scFv comprises an amino acid sequence:

(SEQ ID NO: 585)
DVQITQSPSYLAASPGETITINCRASKSISKYLAWYQEKPGKTNKLLIY

SGSTLQSGIPSRFSGSGSGTDFTLTISSLEPEDFAMYYCQQHNEYPWTF

GGGTKLEIKRGGGGSGGGGSGGGGSVQLKESGPGLVAPSQSLSITCTVS

GFSLTGYGVNWVRQPPGKGLEWLGMIWGDGSTDYNSALKSRLSISKDNS

KSQVFLKMNSLQTDDTARYYCARGGYDFDYWGQGTTLTVSS.

In some embodiments, the anti-CD22 scFv comprises an amino acid sequence:

(SEQ ID NO: 586)
DVQITQSPSYLAASPGETITINCRASKSISKYLAWYQEKPGKTNKLLIY

SGSTLQSGIPSRFSGSGSGTDFTLTISSLEPEDFAMYYCQQHNEYPWTF

GGGTKLEIKRGGGGSGGGGSGGGGSVQLQQSGAELARPGASVKMSCKAS

GYTFTSYWMHWVKQRPGQGLEWIGAIYPGNSDTSYNQKFKGKAKLTAVT

SASTAYMELSSLTNEDSAVYYCTRSHYVEGYFDVWGTGTTVTVSS.

In some embodiments, the anti-CD22 scFv comprises an amino acid sequence:

(SEQ ID NO: 587)
DVQITQSPSYLAASPGETITINCRASKSISKYLAWYQEKPGKTNKLLIY

SGSTLQSGIPSRFSGSGSGTDFTLTISSLEPEDFAMYYCQQHNEYPWTF

GGGTKLEIKRGGGGSGGGGSGGGGSQVKLQQSGAELVKPGASVKISCKA

SGYAFSSSWMNWVKQRPGKGLEWIGQIYPGDGDTKYNGKFKGKATLTAD

KSSSTAYMQLSSLTSEDSAVYFCANSNYPSSQSSRTYSRRDWFAYWGQG

TLVTVSA.

In some embodiments, the anti-CD22 scFv comprises an amino acid sequence:

(SEQ ID NO: 588)
DVQITQSPSYLAASPGETITINCRASKSISKYLAWYQEKPGKTNKLLIY

SGSTLQSGIPSRFSGSGSGTDFTLTISSLEPEDFAMYYCQQHNEYPWTF

GGGTKLEIKRGGGGSGGGGSGGGGSDVKLQESGGGLVKPGGSLKLSCAV

SGFTFSSFAMSWVRQTPEKRLEWVATISSGGAYTFYKDSVKGRFTISRD

NAKNTLYLQMSSLRSEDSAMYYCARHSGYDGYYLYAMDCWGQGTSVTVS

S.

In some embodiments, the anti-CD22 scFv comprises an amino acid sequence:

(SEQ ID NO: 589)
DVQITQSPSYLAASPGETITINCRASKSISKYLAWYQEKPGKTNKLLIY

SGSTLQSGIPSRFSGSGSGTDFTLTISSLEPEDFAMYYCQQHNEYPWTF

GGGTKLEIKRGGGGSGGGGSGGGGSEVKLQQSGGGLVKPGASLKLSCAA

SGFTFSNYGMSWVRQTSDKRLEWVASISSGGGRIYYPDNVKGRFTISRE

NAKNTLYLQMNSLKSDDTALYYCAREPPNYYGGTYGDYWGQGTTLTVSS.

In some embodiments, the anti-CD22 scFv comprises an amino acid sequence:

(SEQ ID NO: 590)
QIVLTQSPVIMSASPGEKVTMTCSASSSVSDMHWYQQKSGTSPKRWIYD

TSKLASGVPARFSGSGSGTSYSLTISSMEAEDAATYYCQQWSSNPLTFG

AGTKLELKRGGGGSGGGGSGGGGSQVKLQQSGAELGKPGTSVKLSCKAS

GYTFTSYWMHWVKQRPGQGLEWIGNINPNSGSTNYNEKFKSKATLTVDK

SSSTAYMQLSTLTSEDSAVYYCTRPGVWGTGTTVTVSS.

In some embodiments, the anti-CD22 scFv comprises an amino acid sequence:

(SEQ ID NO: 591)
QIVLTQSPVIMSASPGEKVTMTCSASSSVSDMHWYQQKSGTSPKRWIYD

TSKLASGVPARFSGSGSGTSYSLTISSMEAEDAATYYCQQWSSNPLTFG

AGTKLELKRGGGGSGGGGGGGGSEVKLQQSGGGLVQPGGSRKLSCAASG

FTFSSFGMHWVRQAPEKGLEWVAYISSGSSTLHYADTVKGRFTISRDNP

KNTLFLQMKLPSLCYGLLGSRNLSHRLLSQNDTPICL.

In some embodiments, the anti-CD22 scFv comprises an amino acid sequence:

(SEQ ID NO: 592)
QIVLTQSPVIMSASPGEKVTMTCSASSSVSDMHWYQQKSGTSPKRWIYD
TSKLASGVPARFSGSGSGTSYSLTISSMEAEDAATYYCQQWSSNPLTFG
AGTKLELKRGGGGSGGGGSGGGGSVKLLESGGGLVQPGGSLKLSCAASG
FEFSRYWMSWVRQVPGKGLEWIGEVNPDSSTINYTTSLKDKFIISRDNA
KNTLYLQMSKVRSEDTALYYCGRDSNYGYFDVWGTGTTVTVSS.

In some embodiments, the anti-CD22 scFv comprises an amino acid sequence:

(SEQ ID NO: 593)
QIVLTQSPVIMSASPGEKVTMTCSASSSVSDMHWYQQKSGTSPKRWIYD
TSKLASGVPARFSGSGSGTSYSLTISSMEAEDAATYYCQQWSSNPLTFG
AGTKLELKRGGGGSGGGGSGGGGSVQLKESGPGLVAPSQSLSITCTVSG
FSLTGYGVNWVRQPPGKGLEWLGMIWGDGSTDYNSALKSRLSISKDNSK
SQVFLKMNSLQTDDTARYYCARGGYDFDYWGQGTTLTVSS.

In some embodiments, the anti-CD22 scFv comprises an amino acid sequence:

(SEQ ID NO: 594)
QIVLTQSPVIMSASPGEKVTMTCSASSSVSDMHWYQQKSGTSPKRWIYD
TSKLASGVPARFSGSGSGTSYSLTISSMEAEDAATYYCQQWSSNPLTFG
AGTKLELKRGGGGSGGGGSGGGGSVQLQQSGAELARPGASVKMSCKASG
YTFTSYWMHWVKQRPGQGLEWIGAIYPGNSDTSYNQKFKGKAKLTAVTS
ASTAYMELSSLTNEDSAVYYCTRSHYVEGYFDVWGTGTTVTVSS.

In some embodiments, the anti-CD22 scFv comprises an amino acid sequence:

(SEQ ID NO: 595)
QIVLTQSPVIMSASPGEKVTMTCSASSSVSDMHWYQQKSGTSPKRWIYD
TSKLASGVPARFSGSGSGTSYSLTISSMEAEDAATYYCQQWSSNPLTFG
AGTKLELKRGGGGSGGGGSGGGGSQVKLQQSGAELVKPGASVKISCKAS
GYAFSSSWMNWVKQRPGKGLEWIGQIYPGDGDTKYNGKFKGKATLTADK
SSSTAYMQLSSLTSEDSAVYFCANSNYPSSQSSRTYSRRDWFAYWGQGT
LVTVSA.

In some embodiments, the anti-CD22 scFv comprises an amino acid sequence:

(SEQ ID NO: 596)
QIVLTQSPVIMSASPGEKVTMTCSASSSVSDMHWYQQKSGTSPKRWIYD
TSKLASGVPARFSGSGSGTSYSLTISSMEAEDAATYYCQQWSSNPLTFG
AGTKLELKRGGGGSGGGGSGGGGSDVKLQESGGGLVKPGGSLKLSCAVS
GFTFSSFAMSWVRQTPEKRLEWVATISSGGAYTFYKDSVKGRFTISRDN
AKNTLYLQMSSLRSEDSAMYYCARHSGYDGYYLYAMDCWGQGTSVTVSS.

In some embodiments, the anti-CD22 scFv comprises an amino acid sequence:

(SEQ ID NO: 597)
QIVLTQSPVIMSASPGEKVTMTCSASSSVSDMHWYQQKSGTSPKRWIYD
TSKLASGVPARFSGSGSGTSYSLTISSMEAEDAATYYCQQWSSNPLTFG
AGTKLELKRGGGGSGGGGSGGGGSEVKLQQSGGGLVKPGASLKLSCAAS
GFTFSNYGMSWVRQTSDKRLEWVASISSGGGRIYYPDNVKGRFTISREN
AKNTLYLQMNSLKSDDTALYYCAREPPNYYGGTYGDYWGQGTTLTVSS.

In some embodiments, the anti-CD22 scFv comprises an amino acid sequence:

(SEQ ID NO: 598)
NIVLTQSPASLAVSLGQRATISCRASESVDSYGNSFMHWYQQKPGQPPK
LLIYLASNLESGVPARFSGSGSRTDFTLTIDPVEADDAATYYCQQNNED
PWTFGGGTKLEIKGGGGSGGGGSGGGGSQVKLQQSGAELGKPGTSVKLS
CKASGYTFTSYWMHWVKQRPGQGLEWIGNINPNSGSTNYNEKFKSKATL
TVDKSSSTAYMQLSTLTSEDSAVYYCTRPGVWGTGTTVTVSS.

In some embodiments, the anti-CD22 scFv comprises an amino acid sequence:

(SEQ ID NO: 599)
NIVLTQSPASLAVSLGQRATISCRASESVDSYGNSFMHWYQQKPGQPPK
LLIYLASNLESGVPARFSGSGSRTDFTLTIDPVEADDAATYYCQQNNED
PWTFGGGTKLEIKGGGGSGGGGSGGGGSEVKLQQSGGGLVQPGGSRKLS
CAASGFTFSSFGMHWVRQAPEKGLEWVAYISSGSSTLHYADTVKGRFTI
SRDNPKNTLFLQMKLPSLCYGLLGSRNLSHRLLSQNDTPICL.

In some embodiments, the anti-CD22 scFv comprises an amino acid sequence:

(SEQ ID NO: 600)
NIVLTQSPASLAVSLGQRATISCRASESVDSYGNSFMHWYQQKPGQPPK
LLIYLASNLESGVPARFSGSGSRTDFTLTIDPVEADDAATYYCQQNNED
PWTFGGGTKLEIKGGGGSGGGGSGGGGSVKLLESGGGLVQPGGSLKLSC
AASGFEFSRYWMSWVRQVPGKGLEWIGEVNPDSSTINYTTSLKDKFIIS
RDNAKNTLYLQMSKVRSEDTALYYCGRDSNYGYFDVWGTGTTVTVSS.

In some embodiments, the anti-CD22 scFv comprises an amino acid sequence:

(SEQ ID NO: 601)
NIVLTQSPASLAVSLGQRATISCRASESVDSYGNSFMHWYQQKPGQPPK
LLIYLASNLESGVPARFSGSGSRTDFTLTIDPVEADDAATYYCQQNNED
PWTFGGGTKLEIKGGGGSGGGGSGGGGSVQLKESGPGLVAPSQSLSITC
TVSGFSLTGYGVNWVRQPPGKGLEWLGMIWGDGSTDYNSALKSRLSISK
DNSKSQVFLKMNSLQTDDTARYYCARGGYDFDYWGQGTTLTVSS.

In some embodiments, the anti-CD22 scFv comprises an amino acid sequence:

```
                                      (SEQ ID NO: 602)
NIVLTQSPASLAVSLGQRATISCRASESVDSYGNSFMHWYQQKPGQPPK

LLIYLASNLESGVPARFSGSGSRTDFTLTIDPVEADDAATYYCQQNNED

PWTFGGGTKLEIKGGGGSGGGGSGGGGSVQLQQSGAELARPGASVKMSC

KASGYTFTSYWMHWVKQRPGQGLEWIGAIYPGNSDTSYNQKFKGKAKLT

AVTSASTAYMELSSLTNEDSAVYYCTRSHYVEGYFDVWGTGTTVTVSS.
```

In some embodiments, the anti-CD22 scFv comprises an amino acid sequence:

```
                                      (SEQ ID NO: 603)
NIVLTQSPASLAVSLGQRATISCRASESVDSYGNSFMHWYQQKPGQPPK

LLIYLASNLESGVPARFSGSGSRTDFTLTIDPVEADDAATYYCQQNNED

PWTFGGGTKLEIKGGGGSGGGGSGGGGSQVKLQQSGAELVKPGASVKIS

CKASGYAFSSSWMNWVKQRPGKGLEWIGQIYPGDGDTKYNGKFKGKATL

TADKSSSTAYMQLSSLTSEDSAVYFCANSNYPSSQSSRTYSRRDWFAYW

GQGTLVTVSA.
```

In some embodiments, the anti-CD22 scFv comprises an amino acid sequence:

```
                                      (SEQ ID NO: 604)
NIVLTQSPASLAVSLGQRATISCRASESVDSYGNSFMHWYQQKPGQPPK

LLIYLASNLESGVPARFSGSGSRTDFTLTIDPVEADDAATYYCQQNNED

PWTFGGGTKLEIKGGGGSGGGGSGGGGSDVKLQESGGGLVKPGGSLKLS

CAVSGFTFSSFAMSWVRQTPEKRLEWVATISSGGAYTFYKDSVKGRFTI

SRDNAKNTLYLQMSSLRSEDSAMYYCARHSGYDGYYLYAMDCWGQGTSV

TVSS.
```

In some embodiments, the anti-CD22 scFv comprises an amino acid sequence:

```
                                      (SEQ ID NO: 605)
NIVLTQSPASLAVSLGQRATISCRASESVDSYGNSFMHWYQQKPGQPPK

LLIYLASNLESGVPARFSGSGSRTDFTLTIDPVEADDAATYYCQQNNED

PWTFGGGTKLEIKGGGGSGGGGSGGGGSEVKLQQSGGGLVKPGASLKLS

CAASGFTFSNYGMSWVRQTSDKRLEWVASISSGGGRIYYPDNVKGRFTI

SRENAKNTLYLQMNSLKSDDTALYYCAREPPNYYGGTYGDYWGQGTTLT

VSS.
```

In some embodiments, the anti-CD22 scFv comprises an amino acid sequence:

```
                                      (SEQ ID NO: 606)
DWVMTQSPLSLPVSLGDQASISCRSSQSLVHSNGNTYLHWYLQKPGQSP

KLLIYKVSNRFSGVPDRFSGSGSGTDFTLKISRVEAEDLGVYFCSQSTH

VSYTFGGGTKLEIKRGGGGSGGGGSGGGGSQVKLQQSGAELGKPGTSVK

LSCKASGYTFTSYWMHWVKQRPGQGLEWIGNINPNSGSTNYNEKFKSKA

TLTVDKSSSTAYMQLSTLTSEDSAVYYCTRPGVWGTGTTVTVSS.
```

In some embodiments, the anti-CD22 scFv comprises an amino acid sequence:

```
                                      (SEQ ID NO: 607)
DWMTQSPLSLPVSLGDQASISCRSSQSLVHSNGNTYLHWYLQKPGQSPK

LLIYKVSNRFSGVPDRFSGSGSGTDFTLKISRVEAEDLGVYFCSQSTHV

SYTFGGGTKLEIKRGGGGSGGGGSGGGGSEVKLQQSGGGLVQPGGSRKL

SCAASGFTFSSFGMHWVRQAPEKGLEWVAYISSGSSTLHYADTVKGRFT

ISRDNPKNTLFLQMKLPSLCYGLLGSRNLSHRLLSQNDTPICL.
```

In some embodiments, the anti-CD22 scFv comprises an amino acid sequence:

```
                                      (SEQ ID NO: 608)
DWMTQSPLSLPVSLGDQASISCRSSQSLVHSNGNTYLHWYLQKPGQSPK

LLIYKVSNRFSGVPDRFSGSGSGTDFTLKISRVEAEDLGVYFCSQSTHV

SYTFGGGTKLEIKRGGGGGGGSGGGGSVKLLESGGGLVQPGGSLKLSC

AASGFEFSRYWMSWVRQVPGKGLEWIGEVNPDSSTINYTTSLKDKFIIS

RDNAKNTLYLQMSKVRSEDTALYYCGRDSNYGYFDVWGTGTTVTVSS.
```

In some embodiments, the anti-CD22 scFv comprises an amino acid sequence:

```
                                      (SEQ ID NO: 609)
DWVMTQSPLSLPVSLGDQASISCRSSQSLVHSNGNTYLHWYLQKPGQSP

KLLIYKVSNRFSGVPDRFSGSGSGTDFTLKISRVEAEDLGVYFCSQSTH

VSYTFGGGTKLEIKRGGGGSGGGGSGGGGSVQLKESGPGLVAPSQSLSI

TCTVSGFSLTGYGVNWVRQPPGKGLEWLGMIWGDGSTDYNSALKSRLSI

SKDNSKSQVFLKMNSLQTDDTARYYCARGGYDFDYWGQGTTLTVSS.
```

In some embodiments, the anti-CD22 scFv comprises an amino acid sequence:

```
                                      (SEQ ID NO: 610)
DWMTQSPLSLPVSLGDQASISCRSSQSLVHSNGNTYLHWYLQKPGQSPK

LLIYKVSNRFSGVPDRFSGSGSGTDFTLKISRVEAEDLGVYFCSQSTHV

SYTFGGGTKLEIKRGGGGSGGGGSGGGGSVQLQQSGAELARPGASVKMS

CKASGYTFTSYWMHWVKQRPGQGLEWIGAIYPGNSDTSYNQKFKGKAKL

TAVTSASTAYMELSSLTNEDSAVYYCTRSHYVEGYFDVWGTGTTVTVSS.
```

In some embodiments, the anti-CD22 scFv comprises an amino acid sequence:

```
                                      (SEQ ID NO: 611)
DWVMTQSPLSLPVSLGDQASISCRSSQSLVHSNGNTYLHWYLQKPGQSP

KLLIYKVSNRFSGVPDRFSGSGSGTDFTLKISRVEAEDLGVYFCSQSTH

VSYTFGGGTKLEIKRGGGGSGGGGSGGGGSQVKLQQSGAELVKPGASVK

ISCKASGYAFSSSWMNWVKQRPGKGLEWIGQIYPGDGDTKYNGKFKGKA
```

-continued

```
TLTADKSSSTAYMQLSSLTSEDSAVYFCANSNYPSSQSSRTYSRRDWFA

YWGQGTLVTVSA.
```

In some embodiments, the anti-CD22 scFv comprises an amino acid sequence:

```
                                        (SEQ ID NO: 612)
DWVMTQSPLSLPVSLGDQASISCRSSQSLVHSNGNTYLHWYLQKPGQSP

KLLIYKVSNRFSGVPDRFSGSGSGTDFTLKISRVEAEDLGVYFCSQSTH

VSYTFGGGTKLEIKRGGGGSGGGGSGGGGSDVKLQESGGGLVKPGGSLK

LSCAVSGFTFSSFAMSWVRQTPEKRLEWVATISSGGAYTFYKDSVKGRF

TISRDNAKNTLYLQMSSLRSEDSAMYYCARHSGYDGYYLYAMDCWGQGT

SVTVSS.
```

In some embodiments, the anti-CD22 scFv comprises an amino acid sequence:

```
                                        (SEQ ID NO: 613)
DVVMTQSPLSLPVSLGDQASISCRSSQSLVHSNGNTYLHWYLQKPGQSP

KLLIYKVSNRFSGVPDRFSGSGSGTDFTLKISRVEAEDLGVYFCSQSTH

VSYTFGGGTKLEIKRGGGGSGGGGSGGGGSEVKLQQSGGGLVKPGASLK

LSCAASGFTFSNYGMSWVRQTSDKRLEWVASISSGGGRIYYPDNVKGRF

TISRENAKNTLYLQMNSLKSDDTALYYCAREPPNYYGGTYGDYWGQGTT

LTVSS.
```

In some embodiments, the anti-CD22 scFv binds to CD22 and comprises an amino acid sequence that is 95%, 96%, 97%, 98% or 99% identical to any of the specific anti-CD22 scFv amino acid sequences disclosed herein.

In some embodiments, the anti-CD22 scFv comprises an antigen binding domain of Inotuzumab (CMC-544, Besponsa, Pfizer), described in CN106661123A, which is incorporated by reference for the teaching of this antibody.

In some embodiments, the anti-CD22 scFv comprises an antigen binding domain of clone Epratuzumab (LymoCide, Immunomedics, Inc.), described in U.S. Pat. No. 9,139,649, which is incorporated by reference for the teaching of this antibody.

In some embodiments, the anti-CD22 scFv comprises an antigen binding domain of clone HB22.7, described in EP1999148B1, which is incorporated by reference for the teaching of this antibody.

In some embodiments, the anti-CD22 scFv comprises an antigen binding domain of Bectumomab (LymphoScan).

In some embodiments, the anti-CD22 scFv comprises an antigen binding domain of clone RFB4 (BL22). In some embodiments, the anti-CD22 scFv comprises an antigen binding domain of clone HA22, described in WO2003027135A2, which is incorporated by reference for the teaching of this antibody.

In some embodiments, the anti-CD22 scFv comprises an antigen binding domain of clone m972, described in WO2009124109A1, which is incorporated by reference for the teaching of this antibody.

In some embodiments, the anti-CD22 scFv comprises an antigen binding domain of clone m971, described in WO2009124109A1, which is incorporated by reference for the teaching of this antibody.

Nucleic Acids and Vectors

Also disclosed are polynucleotides and polynucleotide vectors encoding the disclosed CD19-, CD20-, and CD22-specific CARs that allow expression of the CD19-, CD20-, and CD22-specific CARs in the disclosed immune effector cells.

Nucleic acid sequences encoding the disclosed CARs, and regions thereof, can be obtained using recombinant methods known in the art, such as, for example by screening libraries from cells expressing the gene, by deriving the gene from a vector known to include the same, or by isolating directly from cells and tissues containing the same, using standard techniques. Alternatively, the gene of interest can be produced synthetically, rather than cloned.

Expression of nucleic acids encoding CARs is typically achieved by operably linking a nucleic acid encoding the CAR polypeptide to a promoter, and incorporating the construct into an expression vector. Typical cloning vectors contain transcription and translation terminators, initiation sequences, and promoters useful for regulation of the expression of the desired nucleic acid sequence.

The disclosed nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to a cell in the form of a viral vector. Viral vector technology is well known in the art and is described, for example, in Sambrook et al. (2001, Molecular Cloning: A Laboratory Manual, Cold Spring Harbor Laboratory, New York), and in other virology and molecular biology manuals. Viruses, which are useful as vectors include, but are not limited to, retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers. In some embodiments, the polynucleotide vectors are lentiviral or retroviral vectors.

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo.

One example of a suitable promoter is the immediate early cytomegalovirus (CMV) promoter sequence. This promoter sequence is a strong constitutive promoter sequence capable of driving high levels of expression of any polynucleotide sequence operatively linked thereto. Another example of a suitable promoter is Elongation Growth Factor-1α (EF-1α). However, other constitutive promoter sequences may also be used, including, but not limited to the simian virus 40 (SV40) early promoter, MND (myeloproliferative sarcoma virus) promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the hemoglobin promoter, and the creatine kinase promoter. The promoter can alternatively be an inducible promoter. Examples of inducible promoters include, but are not limited to a metallothionine promoter, a glucocorticoid promoter, a progesterone promoter, and a tetracycline promoter.

Additional promoter elements, e.g., enhancers, regulate the frequency of transcriptional initiation. Typically, these are located in the region 30-110 bp upstream of the start site, although a number of promoters have recently been shown to contain functional elements downstream of the start site as well. The spacing between promoter elements frequently is flexible, so that promoter function is preserved when elements are inverted or moved relative to one another.

In order to assess the expression of a CAR polypeptide or portions thereof, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes.

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, beta-galactosidase, chloramphenicol acetyl transferase, secreted alkaline phosphatase, or the green fluorescent protein gene. Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al. (2001, Molecular Cloning: A Laboratory Manual, Cold Spring Harbor Laboratory, New York).

Biological methods for introducing a polynucleotide of interest into a host cell include the use of DNA and RNA vectors. Viral vectors, and especially retroviral vectors, have become the most widely used method for inserting genes into mammalian, e.g., human cells.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle).

In the case where a non-viral delivery system is utilized, an exemplary delivery vehicle is a liposome. In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes. Lipids suitable for use can be obtained from commercial sources. For example, dimyristyl phosphatidylcholine ("DMPC") can be obtained from Sigma, St. Louis, Mo.; dicetyl phosphate ("DCP") can be obtained from K & K Laboratories (Plainview, N.Y.); cholesterol ("Choi") can be obtained from Calbiochem-Behring; dimyristyl phosphatidylglycerol ("DMPG") and other lipids may be obtained from Avanti Polar Lipids, Inc, (Birmingham, Ala.).

Immune Effector Cells

Also disclosed are immune effector cells that are engineered to express the disclosed CARs (also referred to herein as "CAR-T cells"). These cells are preferably obtained from the subject to be treated (i.e. are autologous). However, in some embodiments, immune effector cell lines or donor effector cells (allogeneic) are used. Immune effector cells can be obtained from a number of sources, including peripheral blood mononuclear cells, bone marrow, lymph node tissue, cord blood, thymus tissue, tissue from a site of infection, ascites, pleural effusion, spleen tissue, and tumors. Immune effector cells can be obtained from blood collected from a subject using any number of techniques known to the skilled artisan, such as Ficoll™ separation. For example, cells from the circulating blood of an individual may be obtained by apheresis. In some embodiments, immune effector cells are isolated from peripheral blood lymphocytes by lysing the red blood cells and depleting the monocytes, for example, by centrifugation through a PERCOLL™ gradient or by counterflow centrifugal elutriation. A specific subpopulation of immune effector cells can be further isolated by positive or negative selection techniques. For example, immune effector cells can be isolated using a combination of antibodies directed to surface markers unique to the positively selected cells, e.g., by incubation with antibody-conjugated beads for a time period sufficient for positive selection of the desired immune effector cells. Alternatively, enrichment of immune effector cells population can be accomplished by negative selection using a combination of antibodies directed to surface markers unique to the negatively selected cells. In some embodiments, the immune effector cells comprise any leukocyte involved in defending the body against infectious disease and foreign materials. For example, the immune effector cells can comprise lymphocytes, monocytes, macrophages, dentritic cells, mast cells, neutrophils, basophils, eosinophils, or any combinations thereof. For example, the immune effector cells can comprise T lymphocytes, preferably cytotoxic T lymphocytes (CTLs).

T cells or T lymphocytes can be distinguished from other lymphocytes, such as B cells and natural killer cells (NK cells), by the presence of a T-cell receptor (TCR) on the cell surface. They are called T cells because they mature in the thymus (although some also mature in the tonsils). There are several subsets of T cells, each with a distinct function.

T helper cells (T H cells) assist other white blood cells in immunologic processes, including maturation of B cells into plasma cells and memory B cells, and activation of cytotoxic T cells and macrophages. These cells are also known as CD4+ T cells because they express the CD4 glycoprotein on their surface. Helper T cells become activated when they are presented with peptide antigens by MHC class II molecules, which are expressed on the surface of antigen-presenting cells (APCs). Once activated, they divide rapidly and secrete small proteins called cytokines that regulate or assist in the active immune response. These cells can differentiate into one of several subtypes, including $T_H1$, $T_H2$, $T_H3$, $T_H17$, $T_H9$, or $T_{FH}$, which secrete different cytokines to facilitate a different type of immune response.

Cytotoxic T cells ($T_C$ cells, or CTLs) destroy virally infected cells and tumor cells, and are also implicated in transplant rejection. These cells are also known as $CD8^+$ T cells since they express the CD8 glycoprotein at their surface. These cells recognize their targets by binding to antigen associated with MHC class I molecules, which are present on the surface of all nucleated cells. Through IL-10, adenosine and other molecules secreted by regulatory T cells, the CD8+ cells can be inactivated to an anergic state, which prevents autoimmune diseases.

Memory T cells are a subset of antigen-specific T cells that persist long-term after an infection has resolved. They quickly expand to large numbers of effector T cells upon re-exposure to their cognate antigen, thus providing the immune system with "memory" against past infections. Memory cells may be either $CD4^+$ or $CD8^+$. Memory T cells typically express the cell surface protein CD45RO.

Regulatory T cells ($T_{reg}$ cells), formerly known as suppressor T cells, are crucial for the maintenance of immunological tolerance. Their major role is to shut down T cell-mediated immunity toward the end of an immune reaction and to suppress auto-reactive T cells that escaped the process of negative selection in the thymus. Two major classes of $CD4^+$ $T_{reg}$ cells have been described—naturally occurring $T_{reg}$ cells and adaptive $T_{reg}$ cells.

Natural killer T (NKT) cells (not to be confused with natural killer (NK) cells) bridge the adaptive immune system with the innate immune system. Unlike conventional T cells that recognize peptide antigens presented by major histocompatibility complex (MHC) molecules, NKT cells recognize glycolipid antigen presented by a molecule called CD1d.

In some embodiments, the T cells comprise a mixture of CD4+ cells. In other embodiments, the T cells are enriched for one or more subsets based on cell surface expression. For example, in some cases, the T comprise are cytotoxic $CD8^+$ T lymphocytes. In some embodiments, the T cells comprise γδ T cells, which possess a distinct T-cell receptor (TCR) having one γ chain and one δ chain instead of a and β chains.

Natural-killer (NK) cells are $CD56^+CD3^-$ large granular lymphocytes that can kill virally infected and transformed cells, and constitute a critical cellular subset of the innate immune system (Godfrey J, et al. Leuk Lymphoma 2012 53:1666-1676). Unlike cytotoxic $CD8^+$ T lymphocytes, NK cells launch cytotoxicity against tumor cells without the requirement for prior sensitization, and can also eradicate MHC-I-negative cells (Narni-Mancinelli E, et al. Int Immunol 2011 23:427-431). NK cells are safer effector cells, as they may avoid the potentially lethal complications of cytokine storms (Morgan R A, et al. Mol Ther 2010 18:843-851), tumor lysis syndrome (Porter D L, et al. N Engl J Med 2011 365:725-733), and on-target, off-tumor effects. Although NK cells have a well-known role as killers of cancer cells, and NK cell impairment has been extensively documented as crucial for progression of MM (Godfrey J, et al. Leuk Lymphoma 2012 53:1666-1676; Fauriat C, et al. Leukemia 2006 20:732-733), the means by which one might enhance NK cell-mediated anti-MM activity has been largely unexplored prior to the disclosed CARs.

Epstein-Barr virus (EBV)-induced lymphoproliferative diseases (EBV-LPDs) and other EBV-associated cancers are a significant cause of morbidity and mortality for recipients of allogeneic hematopoietic cell transplantation (HCT) or solid organ transplants (SOT), particularly in those who have received certain T-cell reactive Abs to prevent or treat GVHD. Prophylaxis and treatment by the adoptive transfer of autologous or allogeneic EBV-specific cytotoxic T cells and the subsequent long-term restoration of immunity against EBV-associated lymphoproliferation have provided positive outcomes in the management of these uniformly fatal complications of allogeneic tissue transfer. Therefore, in some embodiments, the disclosed immune effector cells that comprise one or more of the CAR polypeptides of the present invention are allogeneic or autologous EBV-specific cytotoxic T lymphocytes (CTLs). For example, generation of EBV-specific cytotoxic T cells may involve isolating PBMCs from of an EBV-seropositive autologous or allogenic donor and enriching them for T cells by depletion of monocytes and NK cells. EBV-specific cytotoxic T cells may also be produced by contacting donor PBMCs or purified donor T cells with a "stimulator" cell that expresses one or more EBV antigen(s) and presents the EBV antigen(s) to unstimulated T cells, thereby causing stimulation and expansion of EBV-specific CTLs. EBV antigens include, for example, latent membrane protein (LMP) and EBV nuclear antigen (EBNA) proteins, such as LMP-1, LMP-2A, and LMP-2B and EBNA-1, EBNA-2, EBNA-3A, EBNA-3B, EBNA-3C and EBNA-LP. Cytotoxic T cells that comprise T cell receptor(s) which recognize one or more EBV-specific antigens are deemed to have been "sensitized" to those EBV antigen(s) and are therefore termed "EBV-sensitized cytotoxic T cells" herein. Known methods for generating allogeneic or autologous EBV-specific cytotoxic T cell populations that may comprise one or more of the CAR polypeptides of the present invention are described, for example, in Barker et al., Blood 2010 116(23):5045-49; Doubrovina, et al., Blood 2012 119(11):2644-56; Koehne, et al. Blood 2002 99(5):1730-40; and Smith et al. Cancer Res 2012 72(5):1116-25, which are incorporated by reference for these teachings.

Therapeutic Methods

Immune effector cells expressing the disclosed CARs can elicit an anti-tumor immune response against CD19-, CD20-, and/or CD22-expressing cancer cells. The anti-tumor immune response elicited by the disclosed CAR-modified immune effector cells may be an active or a passive immune response. In addition, the CAR-mediated immune response may be part of an adoptive immunotherapy approach in which CAR-modified immune effector cells induce an immune response specific to CD19, CD20, and/or CD22.

Adoptive transfer of immune effector cells expressing chimeric antigen receptors is a promising anti-cancer therapeutic. Following the collection of a patient's immune effector cells, the cells may be genetically engineered to express the disclosed CD19-, CD20-, and/or CD22-specific CARs, then infused back into the patient. Moreover, immune effector cells obtained from a donor other than the patient (i.e., allogeneic to the patient) may be genetically engineered to express the disclosed CD19-, CD20-, and/or CD22-specific CARs, then the CAR-containing cells infused into the patient. In one specific embodiment, the immune effector cells are allogeneic EBV-specific cytotoxic T cells.

The disclosed CAR-modified immune effector cells may be administered either alone, or as a pharmaceutical composition in combination with diluents and/or with other components such as IL-2, IL-15, or other cytokines or cell populations. Briefly, pharmaceutical compositions may comprise a target cell population as described herein, in combination with one or more pharmaceutically or physiologically acceptable carriers, diluents or excipients. Such compositions may comprise buffers such as neutral buffered saline, phosphate buffered saline and the like; carbohydrates such as glucose, mannose, sucrose or dextrans, mannitol; proteins; polypeptides or amino acids such as glycine; antioxidants; chelating agents such as EDTA or glutathione; adjuvants (e.g., aluminum hydroxide); and preservatives. Compositions for use in the disclosed methods are in some embodiments formulated for intravenous administration. Pharmaceutical compositions may be administered in any manner appropriate treat MM. The quantity and frequency of administration will be determined by such factors as the condition of the patient, and the severity of the patient's disease, although appropriate dosages may be determined by clinical trials.

When "an immunologically effective amount", "an anti-tumor effective amount", "an tumor-inhibiting effective amount", or "therapeutic amount" is indicated, the precise amount of the compositions of the present invention to be administered can be determined by a physician with consideration of individual differences in age, weight, tumor size, extent of infection or metastasis, and condition of the patient (subject). It can generally be stated that a pharmaceutical composition comprising the T cells described herein may be administered at a dosage of $10^4$ to $10^9$ cells/kg body weight, such as $10^5$ to $10^6$ cells/kg body weight, including all integer values within those ranges. T cell compositions may also be administered multiple times at these dosages. The cells can be administered by using infusion techniques that are commonly known in immunotherapy (see, e.g., Rosenberg et al., New Eng. J. of Med. 319:1676, 1988). The optimal dosage and treatment regime for a particular patient can readily be determined by one skilled in the art of medicine by monitoring the patient for signs of disease and adjusting the treatment accordingly.

In certain embodiments, it may be desired to administer activated T cells to a subject and then subsequently re-draw blood (or have an apheresis performed), activate T cells therefrom according to the disclosed methods, and reinfuse the patient with these activated and expanded T cells. This process can be carried out multiple times every few weeks. In certain embodiments, T cells can be activated from blood draws of from 10 cc to 400 cc. In certain embodiments, T cells are activated from blood draws of 20 cc, 30 cc, 40 cc, 50 cc, 60 cc, 70 cc, 80 cc, 90 cc, or 100 cc. Using this multiple blood draw/multiple reinfusion protocol may serve to select out certain populations of T cells.

The administration of the disclosed compositions may be carried out in any convenient manner, including by injection, transfusion, or implantation. The compositions described herein may be administered to a patient subcutaneously, intradermally, intratumorally, intranodally, intramedullary, intramuscularly, by intravenous (i.v.) injection, or intraperitoneally. In some embodiments, the disclosed compositions are administered to a patient by intradermal or subcutaneous injection. In some embodiments, the disclosed compositions are administered by i.v. injection. The compositions may also be injected directly into a tumor, lymph node, or site of infection.

In certain embodiments, the disclosed CAR-modified immune effector cells are administered to a patient in conjunction with (e.g., before, simultaneously or following) any number of relevant treatment modalities, including but not limited to thalidomide, dexamethasone, bortezomib, and lenalidomide. In further embodiments, the CAR-modified immune effector cells may be used in combination with chemotherapy, radiation, immunosuppressive agents, such as cyclosporin, azathioprine, methotrexate, mycophenolate, and FK506, antibodies, or other immunoablative agents such as CAM PATH, anti-CD3 antibodies or other antibody therapies, cytoxin, fludaribine, cyclosporin, FK506, rapamycin, mycophenolic acid, steroids, FR901228, cytokines, and irradiation. In some embodiments, the CAR-modified immune effector cells are administered to a patient in conjunction with (e.g., before, simultaneously or following) bone marrow transplantation, T cell ablative therapy using either chemotherapy agents such as, fludarabine, external-beam radiation therapy (XRT), cyclophosphamide, or antibodies such as OKT3 or CAMPATH. In another embodiment, the cell compositions of the present invention are administered following B-cell ablative therapy such as agents that react with CD20, e.g., Rituxan. For example, in some embodiments, subjects may undergo standard treatment with high dose chemotherapy followed by peripheral blood stem cell transplantation. In certain embodiments, following the transplant, subjects receive an infusion of the expanded immune cells of the present invention. In an additional embodiment, expanded cells are administered before or following surgery.

The cancer of the disclosed methods can be any CD19-, CD20-, and/or CD22-expressing cell in a subject undergoing unregulated growth, invasion, or metastasis. Cancers that express CD19, CD20, or CD22 include prostate cancer, ovarian cancer, adenocarcinoma of the lung, breast cancer, endometrial cancer, gastric cancer, colon cancer, and pancreatic cancer. CD19, CD20, or CD22 has also been found on Jurkat cells. In some aspects, the cancer is a gallbladder cancer, exocrine adenocarcinoma, or apocrine adenocarcinomas.

In some aspects, the cancer can be any neoplasm or tumor for which radiotherapy is currently used. Alternatively, the cancer can be a neoplasm or tumor that is not sufficiently sensitive to radiotherapy using standard methods. Thus, the cancer can be a sarcoma, lymphoma, leukemia, carcinoma, blastoma, or germ cell tumor. A representative but non-limiting list of cancers that the disclosed compositions can be used to treat include lymphoma, B cell lymphoma, T cell lymphoma, mycosis fungoides, Hodgkin's Disease, myeloid leukemia, bladder cancer, brain cancer, nervous system cancer, head and neck cancer, squamous cell carcinoma of head and neck, kidney cancer, lung cancers such as small cell lung cancer and non-small cell lung cancer, neuroblastoma/glioblastoma, ovarian cancer, pancreatic cancer, prostate cancer, skin cancer, liver cancer, melanoma, squamous cell carcinomas of the mouth, throat, larynx, and lung, endometrial cancer, cervical cancer, cervical carcinoma, breast cancer, epithelial cancer, renal cancer, genitourinary cancer, pulmonary cancer, esophageal carcinoma, head and neck carcinoma, large bowel cancer, hematopoietic cancers; testicular cancer; colon and rectal cancers, prostatic cancer, and pancreatic cancer.

The disclosed CARs can be used in combination with any compound, moiety or group which has a cytotoxic or cytostatic effect. Drug moieties include chemotherapeutic agents, which may function as microtubulin inhibitors, mitosis inhibitors, topoisomerase inhibitors, or DNA intercalators, and particularly those which are used for cancer therapy.

The disclosed CARs can be used in combination with a checkpoint inhibitor. The two known inhibitory checkpoint pathways involve signaling through the cytotoxic T-lymphocyte antigen-4 (CTLA-4) and programmed-death 1 (PD-1) receptors. These proteins are members of the CD28-B7 family of cosignaling molecules that play important roles throughout all stages of T cell function. The PD-1 receptor (also known as CD279) is expressed on the surface of activated T cells. Its ligands, PD-L1 (67-H1; CD274) and PD-L2 (B7-DC; CD273), are expressed on the surface of APCs such as dendritic cells or macrophages. PD-L1 is the predominant ligand, while PD-L2 has a much more restricted expression pattern. When the ligands bind to PD-1, an inhibitory signal is transmitted into the T cell, which reduces cytokine production and suppresses T-cell proliferation. Checkpoint inhibitors include, but are not limited to antibodies that block PD-1 (Nivolumab (BMS-936558 or MDX1106), CT-011, MK-3475), PD-L1 (MDX-1105 (BMS-936559), MPDL3280A, MS60010718C), PD-L2 (rHIgM1267), CTLA-4 (Ipilimumab (MDX-010), Tremelimumab (CP-675,206)), IDO, B7-H3 (MGA271), B7-H4, TIM3, LAG-3 (BMS-986016). Techniques for combining CARs with checkpoint inhibitors in immune effector cells and use thereof for the treatment of various disorders are described, for example, in WO 2017/040945, which is incorporated by reference herein.

Human monoclonal antibodies to programmed death 1 (PD-1) and methods for treating cancer using anti-PD-1 antibodies alone or in combination with other immunotherapeutics are described in U.S. Pat. No. 8,008,449, which is incorporated by reference for these antibodies. Anti-PD-L1 antibodies and uses therefor are described in U.S. Pat. No. 8,552,154, which is incorporated by reference for these antibodies. Anticancer agent comprising anti-PD-1 antibody or anti-PD-L1 antibody are described in U.S. Pat. No. 8,617,546, which is incorporated by reference for these antibodies.

In some embodiments, the PDL1 inhibitor comprises an antibody that specifically binds PDL1, such as BMS-936559 (Bristol-Myers Squibb) or MPDL3280A (Roche). In some embodiments, the PD1 inhibitor comprises an antibody that specifically binds PD1, such as lambrolizumab (Merck), nivolumab (Bristol-Myers Squibb), or MED14736 (AstraZeneca). Human monoclonal antibodies to PD-1 and methods for treating cancer using anti-PD-1 antibodies alone or in combination with other immunotherapeutics are described in U.S. Pat. No. 8,008,449, which is incorporated by reference for these antibodies. Anti-PD-L1 antibodies and uses therefor are described in U.S. Pat. No. 8,552,154, which is incorporated by reference for these antibodies. Anticancer agent comprising anti-PD-1 antibody or anti-PD-L1 antibody are described in U.S. Pat. No. 8,617,546, which is incorporated by reference for these antibodies.

The disclosed CARs can be used in combination with other cancer immunotherapies. There are two distinct types of immunotherapy: passive immunotherapy uses components of the immune system to direct targeted cytotoxic activity against cancer cells, without necessarily initiating an immune response in the patient, while active immunotherapy actively triggers an endogenous immune response. Passive strategies include the use of the monoclonal antibodies (mAbs) produced by B cells in response to a specific antigen. The development of hybridoma technology in the 1970s and the identification of tumor-specific antigens permitted the pharmaceutical development of mAbs that could specifically target tumor cells for destruction by the immune system. Thus far, mAbs have been the biggest success story for immunotherapy; the top three best-selling anticancer drugs in 2012 were mAbs. Among them is rituximab (Rituxan, Genentech), which binds to the CD20 protein that is highly expressed on the surface of B cell malignancies such as non-Hodgkin's lymphoma (NHL). Rituximab is approved by the FDA for the treatment of NHL and chronic lymphocytic leukemia (CLL) in combination with chemotherapy. Another important mAb is trastuzumab (Herceptin; Genentech), which revolutionized the treatment of HER2 (human epidermal growth factor receptor 2)-positive breast cancer by targeting the expression of HER2.

Generating optimal "killer" CD8 T cell responses also requires T cell receptor activation plus co-stimulation, which can be provided through ligation of tumor necrosis factor receptor family members, including OX40 (CD134) and 4-1BB (CD137). OX40 is of particular interest as treatment with an activating (agonist) anti-OX40 mAb augments T cell differentiation and cytolytic function leading to enhanced anti-tumor immunity against a variety of tumors.

In some embodiments, such an additional therapeutic agent may be selected from an antimetabolite, such as methotrexate, 6-mercaptopurine, 6-thioguanine, cytarabine, fludarabine, 5-fluorouracil, decarbazine, hydroxyurea, asparaginase, gemcitabine or cladribine.

In some embodiments, such an additional therapeutic agent may be selected from an alkylating agent, such as mechlorethamine, thioepa, chlorambucil, melphalan, carmustine (BSNU), lomustine (CCNU), cyclophosphamide, busulfan, dibromomannitol, streptozotocin, dacarbazine (DTIC), procarbazine, mitomycin C, cisplatin and other platinum derivatives, such as carboplatin.

In some embodiments, such an additional therapeutic agent may be selected from an anti-mitotic agent, such as taxanes, for instance docetaxel, and paclitaxel, and *vinca* alkaloids, for instance vindesine, vincristine, vinblastine, and vinorelbine.

In some embodiments, such an additional therapeutic agent may be selected from a topoisomerase inhibitor, such as topotecan or irinotecan, or a cytostatic drug, such as etoposide and teniposide.

In some embodiments, such an additional therapeutic agent may be selected from a growth factor inhibitor, such as an inhibitor of ErbBI (EGFR) (such as an EGFR antibody, e.g. zalutumumab, cetuximab, panitumumab or nimotuzumab or other EGFR inhibitors, such as gefitinib or erlotinib), another inhibitor of ErbB2 (HER2/neu) (such as a HER2 antibody, e.g. trastuzumab, trastuzumab-DM I or pertuzumab) or an inhibitor of both EGFR and HER2, such as lapatinib).

In some embodiments, such an additional therapeutic agent may be selected from a tyrosine kinase inhibitor, such as imatinib (Glivec, Gleevec STI571) or lapatinib.

Therefore, in some embodiments, a disclosed antibody is used in combination with ofatumumab, zanolimumab, daratumumab, ranibizumab, nimotuzumab, panitumumab, hu806, daclizumab (Zenapax), basiliximab (Simulect), infliximab (Remicade), adalimumab (Humira), natalizumab (Tysabri), omalizumab (Xolair), efalizumab (Raptiva), and/or rituximab.

In some embodiments, a therapeutic agent for use in combination with a CARs for treating the disorders as described above may be an anti-cancer cytokine, chemokine, or combination thereof. Examples of suitable cytokines and growth factors include IFNy, IL-2, IL-4, IL-6, IL-7, IL-10, IL-12, IL-13, IL-15, IL-18, IL-23, IL-24, IL-27, IL-28a, IL-28b, IL-29, KGF, IFNa (e.g., INFa2b), IFN, GM-CSF, CD40L, Flt3 ligand, stem cell factor, ancestim, and TNFa. Suitable chemokines may include Glu-Leu-Arg (ELR)-negative chemokines such as IP-10, MCP-3, MIG, and SDF-Ia from the human CXC and C-C chemokine families. Suitable cytokines include cytokine derivatives, cytokine variants, cytokine fragments, and cytokine fusion proteins.

In some embodiments, a therapeutic agent for use in combination with a CARs for treating the disorders as described above may be a cell cycle control/apoptosis regulator (or "regulating agent"). A cell cycle control/apoptosis regulator may include molecules that target and modulate cell cycle control/apoptosis regulators such as (i) cdc-25 (such as NSC 663284), (ii) cyclin-dependent kinases that overstimulate the cell cycle (such as flavopiridol (L868275, HMR1275), 7-hydroxystaurosporine (UCN-01, KW-2401), and roscovitine (R-roscovitine, CYC202)), and (iii) telomerase modulators (such as BIBR1532, SOT-095, GRN163 and compositions described in for instance U.S. Pat. Nos. 6,440,735 and 6,713,055). Non-limiting examples of molecules that interfere with apoptotic pathways include TNF-related apoptosis-inducing ligand (TRAIL)/apoptosis-2 ligand (Apo-2L), antibodies that activate TRAIL receptors, IFNs, and anti-sense Bcl-2.

In some embodiments, a therapeutic agent for use in combination with a CARs for treating the disorders as described above may be a hormonal regulating agent, such as agents useful for anti-androgen and anti-estrogen therapy. Examples of such hormonal regulating agents are tamoxifen, idoxifene, fulvestrant, droloxifene, toremifene, raloxifene, diethylstilbestrol, ethinyl estradiol/estinyl, an antiandrogene (such as flutaminde/eulexin), a progestin (such as such as hydroxyprogesterone caproate, medroxy-progesterone/provera, megestrol acepate/megace), an adrenocorticosteroid (such as hydrocortisone, prednisone), luteinizing hormone-releasing hormone (and analogs thereof and other LHRH agonists such as buserelin and goserelin), an aromatase inhibitor (such as anastrazole/arimidex, aminoglutethimide/cytraden, exemestane) or a hormone inhibitor (such as octreotide/sandostatin).

In some embodiments, a therapeutic agent for use in combination with an CARs for treating the disorders as described above may be an anti-cancer nucleic acid or an anti-cancer inhibitory RNA molecule.

Combined administration, as described above, may be simultaneous, separate, or sequential. For simultaneous administration the agents may be administered as one composition or as separate compositions, as appropriate.

In some embodiments, the disclosed CARs is administered in combination with radiotherapy. Radiotherapy may comprise radiation or associated administration of radiopharmaceuticals to a patient is provided. The source of radiation may be either external or internal to the patient being treated (radiation treatment may, for example, be in the form of external beam radiation therapy (EBRT) or brachytherapy (BT)). Radioactive elements that may be used in practicing such methods include, e.g., radium, cesium-137, iridium-192, americium-241, gold-198, cobalt-57, copper-67, technetium-99, iodide-123, iodide-131, and indium-111.

In some embodiments, the disclosed CARs is administered in combination with surgery.

CAR-T cells may be designed in several ways that enhance tumor cytotoxicity and specificity, evade tumor immunosuppression, avoid host rejection, and prolong their therapeutic half-life. TRUCK (T-cells Redirected for Universal Cytokine Killing) T cells for example, possess a CAR but are also engineered to release cytokines such as IL-12 that promote tumor killing. Because these cells are designed to release a molecular payload upon activation of the CAR once localized to the tumor environment, these CAR-T cells are sometimes also referred to as 'armored CARs'. Several cytokines as cancer therapies are being investigated both pre-clinically and clinically, and may also prove useful when similarly incorporated into a TRUCK form of CAR-T therapy. Among these include IL-2, IL-3. IL-4, IL-5, IL-6, IL-7, IL-10, IL-12, IL-13, IL-15, IL-18, M-CSF, GM-CSF, IFN-α, IFN-γ, TNF-α, TRAIL, FLT3 ligand, Lymphotactin, and TGF-β (Dranoff 2004). "Self-driving" or "homing" CAR-T cells are engineered to express a chemokine receptor in addition to their CAR. As certain chemokines can be upregulated in tumors, incorporation of a chemokine receptor aids in tumor trafficking to and infiltration by the adoptive T-cell, thereby enhancing both specificity and functionality of the CAR-T (Moon 2011). Universal CAR-T cells also possess a CAR, but are engineered such that they do not express endogenous TCR (T-cell receptor) or MHC (major histocompatibility complex) proteins. Removal of these two proteins from the signaling repertoire of the adoptive T-cell therapy prevents graft-versus-host-disease and rejection, respectively. Armored CAR-T cells are additionally so named for their ability to evade tumor immunosuppression and tumor-induced CAR-T hypofunction. These particular CAR-Ts possess a CAR, and may be engineered to not express checkpoint inhibitors. Alternatively, these CAR-Ts can be co-administered with a monoclonal antibody (mAb) that blocks checkpoint signaling. Administration of an anti-PDL1 antibody significantly restored the killing ability of CAR TILs (tumor infiltrating lymphocytes). While PD1-PDL1 and CTLA-4-CD80/CD86 signaling pathways have been investigated, it is possible to target other immune checkpoint signaling molecules in the design of an armored CAR-T including LAG-3, Tim-3, IDO-1, 2B4, and KIR. Other intracellular inhibitors of TILs include phosphatases (SHP1), ubiquitin-ligases (i.e., cbl-b), and kinases (i.e., diacylglycerol kinase). Armored CAR-Ts may also be engineered to express proteins or receptors that protect them against or make them resistant to the effects of tumor-secreted cytokines. For example, CTLs (cytotoxic T lymphocytes) transduced with the double negative form of the TGF-6 receptor are resistant to the immunosuppression by lymphoma secreted TGF-6. These transduced cells showed notably increased antitumor activity in vivo when compared to their control counterparts.

Tandem and dual CAR-T cells are unique in that they possess two distinct antigen binding domains. A tandem CAR contains two sequential antigen binding domains facing the extracellular environment connected to the intracellular costimulatory and stimulatory domains. A dual CAR is engineered such that one extracellular antigen binding domain is connected to the intracellular costimulatory domain and a second, distinct extracellular antigen binding domain is connected to the intracellular stimulatory domain. Because the stimulatory and costimulatory domains are split between two separate antigen binding domains, dual CARs are also referred to as "split CARs". In both tandem and dual CAR designs, binding of both antigen binding domains is necessary to allow signaling of the CAR circuit in the T-cell. Because these two CAR designs have binding affinities for different, distinct antigens, they are also referred to as "bi-specific" CARs.

One primary concern with CAR-T cells as a form of "living therapeutic" is their manipulability in vivo and their potential immune-stimulating side effects. To better control CAR-T therapy and prevent against unwanted side effects, a variety of features have been engineered including off-switches, safety mechanisms, and conditional control mechanisms. Both self-destruct and marked/tagged CAR-T cells for example, are engineered to have an "off-switch" that promotes clearance of the CAR-expressing T-cell. A self-destruct CAR-T contains a CAR, but is also engineered to express a pro-apoptotic suicide gene or "elimination gene" inducible upon administration of an exogenous molecule. A variety of suicide genes may be employed for this purpose, including HSV-TK (herpes simplex virus thymidine kinase), Fas, iCasp9 (inducible caspase 9), CD20, MYC TAG, and truncated EGFR (endothelial growth factor receptor). HSK for example, will convert the prodrug ganciclovir (GCV) into GCV-triphosphate that incorporates itself into replicating DNA, ultimately leading to cell death. iCasp9 is a chimeric protein containing components of FK506-binding protein that binds the small molecule AP1903, leading to caspase 9 dimerization and apoptosis. A marked/tagged CAR-T cell however, is one that possesses a CAR but also is engineered to express a selection marker. Administration of a mAb against this selection marker will promote clearance of the CAR-T cell. Truncated EGFR is one such targetable antigen by the anti-EGFR mAb, and administration of cetuximab works to promotes elimination of the CAR-T cell. CARs created to have these features are also referred to as sCARs for 'switchable CARs', and RCARs for 'regulatable CARs'. A "safety CAR", also known as an "inhibitory CAR" (iCAR), is engineered to express two antigen binding domains. One of these extracellular domains is directed against a tumor related antigen and bound to an intracellular costimulatory and stimulatory domain. The second extracellular antigen binding domain however is specific for normal tissue and bound to an intracellular checkpoint domain such as CTLA4, PD1, or CD45. Incorporation of multiple intracellular inhibitory domains to the iCAR is also possible. Some inhibitory molecules that may provide these inhibitory domains include B7-H1, B7-1, CD160, PIH, 2B4, CEACAM (CEACAM-1. CEACAM-3, and/or CEACAM-5), LAG-3, TIGIT, BTLA, LAIR1, and TGFβ-R. In the presence of normal tissue, stimulation of this second antigen binding domain will work to inhibit the CAR. It should be noted that due to this dual antigen specificity, iCARs are also a form of bi-specific CAR-T cells. The safety CAR-T engineering enhances specificity of the CAR-T cell for tumor tissue, and is advantageous in situations where certain normal tissues may express very low levels of a tumor associated antigen that would lead to off target effects with a standard CAR (Morgan 2010). A conditional CAR-T cell expresses an extracellular antigen binding domain connected to an intracellular costimulatory domain and a separate, intracellular costimulator. The costimulatory and stimulatory domain sequences are engineered in such a way that upon administration of an exogenous molecule the resultant proteins will come together intracellularly to complete the CAR circuit. In this way, CAR-T activation can be modulated, and possibly even 'fine-tuned' or personalized to a specific patient. Similar to a dual CAR design, the stimulatory and costimulatory domains are physically separated when inactive in the conditional CAR; for this reason these too are also referred to as a "split CAR".

In some embodiments, two or more of these engineered features may be combined to create an enhanced, multifunctional CAR-T. For example, it is possible to create a CAR-T cell with either dual- or conditional-CAR design that also releases cytokines like a TRUCK. In some embodiments, a dual-conditional CAR-T cell could be made such that it expresses two CARs with two separate antigen binding domains against two distinct cancer antigens, each bound to their respective costimulatory domains. The costimulatory domain would only become functional with the stimulatory domain after the activating molecule is administered. For this CAR-T cell to be effective the cancer must express both cancer antigens and the activating molecule must be administered to the patient; this design thereby incorporating features of both dual and conditional CAR-T cells.

Typically, CAR-T cells are created using α-β T cells, however γ-δ T cells may also be used. In some embodiments, the described CAR constructs, domains, and engineered features used to generate CAR-T cells could similarly be employed in the generation of other types of CAR-expressing immune cells including NK (natural killer) cells, B cells, mast cells, myeloid-derived phagocytes, and NKT cells. Alternatively, a CAR-expressing cell may be created to have properties of both T-cell and NK cells. In an additional embodiment, the transduced with CARs may be autologous or allogeneic.

Several different methods for CAR expression may be used including retroviral transduction (including γ-retroviral), lentiviral transduction, transposon/transposases (Sleeping Beauty and PiggyBac systems), and messenger RNA transfer-mediated gene expression. Gene editing (gene insertion or gene deletion/disruption) has become of increasing importance with respect to the possibility for engineering CAR-T cells as well. CRISPR-Cas9, ZFN (zinc finger nuclease), and TALEN (transcription activator like effector nuclease) systems are three potential methods through which CAR-T cells may be generated.

Definitions

The term "amino acid sequence" refers to a list of abbreviations, letters, characters or words representing amino acid residues. The amino acid abbreviations used herein are conventional one letter codes for the amino acids and are expressed as follows: A, alanine; B, asparagine or aspartic acid; C, cysteine; D aspartic acid; E, glutamate, glutamic acid; F, phenylalanine; G, glycine; H histidine; I isoleucine; K, lysine; L, leucine; M, methionine; N, asparagine; P, proline; Q, glutamine; R, arginine; S, serine; T, threonine; V, valine; W, tryptophan; Y, tyrosine; Z, glutamine or glutamic acid.

The term "antibody" refers to an immunoglobulin, derivatives thereof which maintain specific binding ability, and proteins having a binding domain which is homologous or largely homologous to an immunoglobulin binding domain. These proteins may be derived from natural sources, or partly or wholly synthetically produced. An antibody may be monoclonal or polyclonal. The antibody may be a member of any immunoglobulin class from any species, including any of the human classes: IgG, IgM, IgA, IgD, and IgE. In exemplary embodiments, antibodies used with the methods and compositions described herein are derivatives of the IgG class.

In addition to intact immunoglobulin molecules, also included in the term "antibodies" are fragments or polymers of those immunoglobulin molecules, and human or humanized versions of immunoglobulin molecules that selectively bind the target antigen.

The term "antibody fragment" refers to any derivative of an antibody which is less than full-length. In exemplary embodiments, the antibody fragment retains at least a significant portion of the full-length antibody's specific binding ability. Examples of antibody fragments include, but are not limited to, Fab, Fab', F(ab')2, scFv, Fv, dsFv diabody, Fc, and Fd fragments. The antibody fragment may be produced by any means. For instance, the antibody fragment may be enzymatically or chemically produced by fragmentation of an intact antibody, it may be recombinantly produced from a gene encoding the partial antibody sequence, or it may be wholly or partially synthetically produced. The antibody fragment may optionally be a single chain antibody fragment. Alternatively, the fragment may comprise multiple chains which are linked together, for instance, by disulfide linkages. The fragment may also optionally be a multimolecular complex. A functional antibody fragment will typically comprise at least about 50 amino acids and more typically will comprise at least about 200 amino acids.

The term "antigen binding site" refers to a region of an antibody that specifically binds an epitope on an antigen.

The term "aptamer" refers to oligonucleic acid or peptide molecules that bind to a specific target molecule. These molecules are generally selected from a random sequence pool. The selected aptamers are capable of adapting unique tertiary structures and recognizing target molecules with high affinity and specificity. A "nucleic acid aptamer" is a DNA or RNA oligonucleic acid that binds to a target molecule via its conformation, and thereby inhibits or suppresses functions of such molecule. A nucleic acid aptamer may be constituted by DNA, RNA, or a combination thereof. A "peptide aptamer" is a combinatorial protein molecule with a variable peptide sequence inserted within a constant scaffold protein. Identification of peptide aptamers is typically performed under stringent yeast dihybrid conditions, which enhances the probability for the selected peptide aptamers to be stably expressed and correctly folded in an intracellular context.

The term "carrier" means a compound, composition, substance, or structure that, when in combination with a compound or composition, aids or facilitates preparation, storage, administration, delivery, effectiveness, selectivity, or any other feature of the compound or composition for its intended use or purpose. For example, a carrier can be selected to minimize any degradation of the active ingredient and to minimize any adverse side effects in the subject.

The term "chimeric molecule" refers to a single molecule created by joining two or more molecules that exist separately in their native state. The single, chimeric molecule has the desired functionality of all of its constituent molecules. One type of chimeric molecules is a fusion protein.

The term "engineered antibody" refers to a recombinant molecule that comprises at least an antibody fragment comprising an antigen binding site derived from the variable domain of the heavy chain and/or light chain of an antibody and may optionally comprise the entire or part of the variable and/or constant domains of an antibody from any of the Ig classes (for example IgA, IgD, IgE, IgG, IgM and IgY).

The term "epitope" refers to the region of an antigen to which an antibody binds preferentially and specifically. A monoclonal antibody binds preferentially to a single specific epitope of a molecule that can be molecularly defined. In the present invention, multiple epitopes can be recognized by a multispecific antibody.

The term "fusion protein" refers to a polypeptide formed by the joining of two or more polypeptides through a peptide bond formed between the amino terminus of one polypeptide and the carboxyl terminus of another polypeptide. The fusion protein can be formed by the chemical coupling of the constituent polypeptides or it can be expressed as a single polypeptide from nucleic acid sequence encoding the single contiguous fusion protein. A single chain fusion protein is a fusion protein having a single contiguous polypeptide backbone. Fusion proteins can be prepared using conventional techniques in molecular biology to join the two genes in frame into a single nucleic acid, and then expressing the nucleic acid in an appropriate host cell under conditions in which the fusion protein is produced.

The term "Fab fragment" refers to a fragment of an antibody comprising an antigen-binding site generated by cleavage of the antibody with the enzyme papain, which cuts at the hinge region N-terminally to the inter-H-chain disulfide bond and generates two Fab fragments from one antibody molecule.

The term "F(ab')2 fragment" refers to a fragment of an antibody containing two antigen-binding sites, generated by cleavage of the antibody molecule with the enzyme pepsin which cuts at the hinge region C-terminally to the inter-H-chain disulfide bond.

The term "Fc fragment" refers to the fragment of an antibody comprising the constant domain of its heavy chain.

The term "Fv fragment" refers to the fragment of an antibody comprising the variable domains of its heavy chain and light chain.

"Gene construct" refers to a nucleic acid, such as a vector, plasmid, viral genome or the like which includes a "coding sequence" for a polypeptide or which is otherwise transcribable to a biologically active RNA (e.g., antisense, decoy, ribozyme, etc.), may be transfected into cells, e.g. in certain embodiments mammalian cells, and may cause expression of the coding sequence in cells transfected with the construct. The gene construct may include one or more regulatory elements operably linked to the coding sequence, as well as intronic sequences, polyadenylation sites, origins of replication, marker genes, etc.

The term "identity" refers to sequence identity between two nucleic acid molecules or polypeptides. Identity can be determined by comparing a position in each sequence which may be aligned for purposes of comparison. When a position in the compared sequence is occupied by the same base, then the molecules are identical at that position. A degree of similarity or identity between nucleic acid or amino acid sequences is a function of the number of identical or matching nucleotides at positions shared by the nucleic acid sequences. Various alignment algorithms and/or programs may be used to calculate the identity between two sequences, including FASTA, or BLAST which are available as a part of the GCG sequence analysis package (University of Wisconsin, Madison, Wis.), and can be used with, e.g., default setting. For example, polypeptides having at least 70%, 85%, 90%, 95%, 98% or 99% identity to specific polypeptides described herein and preferably exhibiting substantially the same functions, as well as polynucleotide encoding such polypeptides, are contemplated. Unless otherwise indicated a similarity score will be based on use of BLOSUM62. When BLASTP is used, the percent similarity is based on the BLASTP positives score and the percent sequence identity is based on the BLASTP identities score. BLASTP "Identities" shows the number and fraction of total residues in the high scoring sequence pairs which are identical; and BLASTP "Positives" shows the number and fraction of residues for which the alignment scores have positive values and which are similar to each other. Amino acid sequences having these degrees of identity or similarity or any intermediate degree of identity of similarity to the amino acid sequences disclosed herein are contemplated and encompassed by this disclosure. The polynucleotide sequences of similar polypeptides are deduced using the genetic code and may be obtained by conventional means, in particular by reverse translating its amino acid sequence using the genetic code.

The term "linker" is art-recognized and refers to a molecule or group of molecules connecting two compounds, such as two polypeptides. The linker may be comprised of a single linking molecule or may comprise a linking molecule and a spacer molecule, intended to separate the linking molecule and a compound by a specific distance.

The term "multivalent antibody" refers to an antibody or engineered antibody comprising more than one antigen recognition site. For example, a "bivalent" antibody has two antigen recognition sites, whereas a "tetravalent" antibody has four antigen recognition sites. The terms "monospecific", "bispecific", "trispecific", "tetraspecific", etc. refer to the number of different antigen recognition site specificities (as opposed to the number of antigen recognition sites) present in a multivalent antibody. For example, a "monospecific" antibody's antigen recognition sites all bind the same epitope. A "bispecific" antibody has at least one antigen recognition site that binds a first epitope and at least one antigen recognition site that binds a second epitope that is different from the first epitope. A "multivalent monospecific" antibody has multiple antigen recognition sites that all bind the same epitope. A "multivalent bispecific" antibody has multiple antigen recognition sites, some number of which bind a first epitope and some number of which bind a second epitope that is different from the first epitope.

The term "nucleic acid" refers to a natural or synthetic molecule comprising a single nucleotide or two or more nucleotides linked by a phosphate group at the 3' position of one nucleotide to the 5' end of another nucleotide. The nucleic acid is not limited by length, and thus the nucleic acid can include deoxyribonucleic acid (DNA) or ribonucleic acid (RNA).

The term "operably linked to" refers to the functional relationship of a nucleic acid with another nucleic acid sequence. Promoters, enhancers, transcriptional and translational stop sites, and other signal sequences are examples of nucleic acid sequences operably linked to other sequences. For example, operable linkage of DNA to a transcriptional control element refers to the physical and functional relationship between the DNA and promoter such that the transcription of such DNA is initiated from the promoter by an RNA polymerase that specifically recognizes, binds to and transcribes the DNA.

The terms "peptide," "protein," and "polypeptide" are used interchangeably to refer to a natural or synthetic molecule comprising two or more amino acids linked by the carboxyl group of one amino acid to the alpha amino group of another.

The term "pharmaceutically acceptable" refers to those compounds, materials, compositions, and/or dosage forms which are, within the scope of sound medical judgment, suitable for use in contact with the tissues of human beings and animals without excessive toxicity, irritation, allergic response, or other problems or complications commensurate with a reasonable benefit/risk ratio.

The terms "polypeptide fragment" or "fragment", when used in reference to a particular polypeptide, refers to a polypeptide in which amino acid residues are deleted as compared to the reference polypeptide itself, but where the remaining amino acid sequence is usually identical to that of the reference polypeptide. Such deletions may occur at the amino-terminus or carboxy-terminus of the reference polypeptide, or alternatively both. Fragments typically are at least about 5, 6, 8 or 10 amino acids long, at least about 14 amino acids long, at least about 20, 30, 40 or 50 amino acids long, at least about 75 amino acids long, or at least about 100, 150, 200, 300, 500 or more amino acids long. A fragment can retain one or more of the biological activities of the reference polypeptide. In various embodiments, a fragment may comprise an enzymatic activity and/or an interaction site of the reference polypeptide. In another embodiment, a fragment may have immunogenic properties.

The term "protein domain" refers to a portion of a protein, portions of a protein, or an entire protein showing structural integrity; this determination may be based on amino acid composition of a portion of a protein, portions of a protein, or the entire protein.

The term "single chain variable fragment or scFv" refers to an Fv fragment in which the heavy chain domain and the light chain domain are linked. One or more scFv fragments may be linked to other antibody fragments (such as the constant domain of a heavy chain or a light chain) to form antibody constructs having one or more antigen recognition sites.

A "spacer" as used herein refers to a peptide that joins the proteins comprising a fusion protein. Generally a spacer has no specific biological activity other than to join the proteins or to preserve some minimum distance or other spatial relationship between them. However, the constituent amino acids of a spacer may be selected to influence some property of the molecule such as the folding, net charge, or hydrophobicity of the molecule.

The term "specifically binds", as used herein, when referring to a polypeptide (including antibodies) or receptor, refers to a binding reaction which is determinative of the presence of the protein or polypeptide or receptor in a heterogeneous population of proteins and other biologics. Thus, under designated conditions (e.g. immunoassay conditions in the case of an antibody), a specified ligand or antibody "specifically binds" to its particular "target" (e.g. an antibody specifically binds to an endothelial antigen) when it does not bind in a significant amount to other proteins present in the sample or to other proteins to which the ligand or antibody may come in contact in an organism. Generally, a first molecule that "specifically binds" a second molecule has an affinity constant (Ka) greater than about $10^5$ $M^{-1}$ (e.g., $10^6$ $M^{-1}$, $10^7$ $M^{-1}$, $10^8$ $M^{-1}$, $10^9$ $M^{-1}$, $10^{10}$ $M^{-1}$, $10^{11}$ $M^{-1}$, and $10^{12}$ $M^{-1}$ or more) with that second molecule.

The term "specifically deliver" as used herein refers to the preferential association of a molecule with a cell or tissue bearing a particular target molecule or marker and not to cells or tissues lacking that target molecule. It is, of course, recognized that a certain degree of non-specific interaction may occur between a molecule and a non-target cell or tissue. Nevertheless, specific delivery, may be distinguished as mediated through specific recognition of the target molecule. Typically specific delivery results in a much stronger association between the delivered molecule and cells bearing the target molecule than between the delivered molecule and cells lacking the target molecule.

The term "subject" refers to any individual who is the target of administration or treatment. The subject can be a vertebrate, for example, a mammal. Thus, the subject can be a human or veterinary patient. The term "patient" refers to a subject under the treatment of a clinician, e.g., physician.

The term "therapeutically effective" refers to the amount of the composition used is of sufficient quantity to ameliorate one or more causes or symptoms of a disease or disorder. Such amelioration only requires a reduction or alteration, not necessarily elimination.

The terms "transformation" and "transfection" mean the introduction of a nucleic acid, e.g., an expression vector, into a recipient cell including introduction of a nucleic acid to the chromosomal DNA of said cell.

The term "treatment" refers to the medical management of a patient with the intent to cure, ameliorate, stabilize, or prevent a disease, pathological condition, or disorder. This term includes active treatment, that is, treatment directed specifically toward the improvement of a disease, pathological condition, or disorder, and also includes causal treatment, that is, treatment directed toward removal of the cause of the associated disease, pathological condition, or disorder. In addition, this term includes palliative treatment, that is, treatment designed for the relief of symptoms rather than the curing of the disease, pathological condition, or disorder; preventative treatment, that is, treatment directed to minimizing or partially or completely inhibiting the development of the associated disease, pathological condition, or disorder; and supportive treatment, that is, treatment employed to supplement another specific therapy directed toward the improvement of the associated disease, pathological condition, or disorder.

The term "variant" refers to an amino acid or peptide sequence having conservative amino acid substitutions, non-conservative amino acid substitutions (i.e. a degenerate variant), substitutions within the wobble position of each codon (i.e. DNA and RNA) encoding an amino acid, amino acids added to the C-terminus of a peptide, or a peptide having 60%, 70%, 80%, 90%, 95%, 96%, 97%, 98%, 99% sequence identity to a reference sequence.

The term "vector" refers to a nucleic acid sequence capable of transporting into a cell another nucleic acid to which the vector sequence has been linked. The term "expression vector" includes any vector, (e.g., a plasmid, cosmid or phage chromosome) containing a gene construct in a form suitable for expression by a cell (e.g., linked to a transcriptional control element).

A number of embodiments of the invention have been described. Nevertheless, it will be understood that various modifications may be made without departing from the spirit and scope of the invention. Accordingly, other embodiments are within the scope of the following claims.

EXAMPLES

Example 1

Figure 1A:
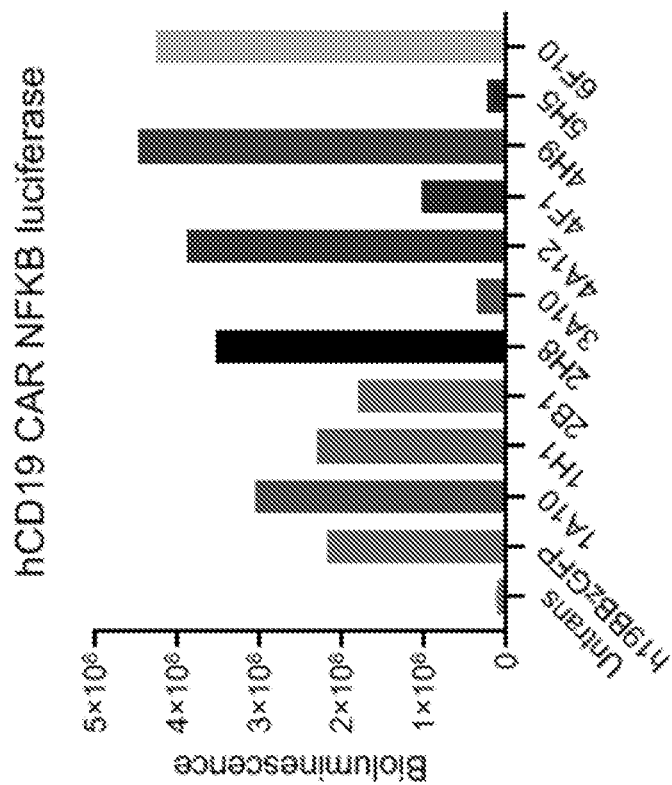

FIG. 1. Human CD19 CARs and human CD22 CARs induce NF-κB in NF-κB293 reporter cells. NF-κB293 reporter cells stably express a transgene, in which NF-κB responsive transcriptional elements are placed upstream of a minimal CMV-GFP-luciferase cassette. So, luciferase activity reflects activity of NF-κB signaling pathway. CAR constructs were packaged into recombinant retrovirus, which was used to transduce NF-κB293 reporter cells. Forty-eight hours later, cell lysates were prepared from transduced reporter cells and untransduced controls. NF-κB activation was evaluated using luciferase assay (FIGS. 1A and 1B).

Figure 2:
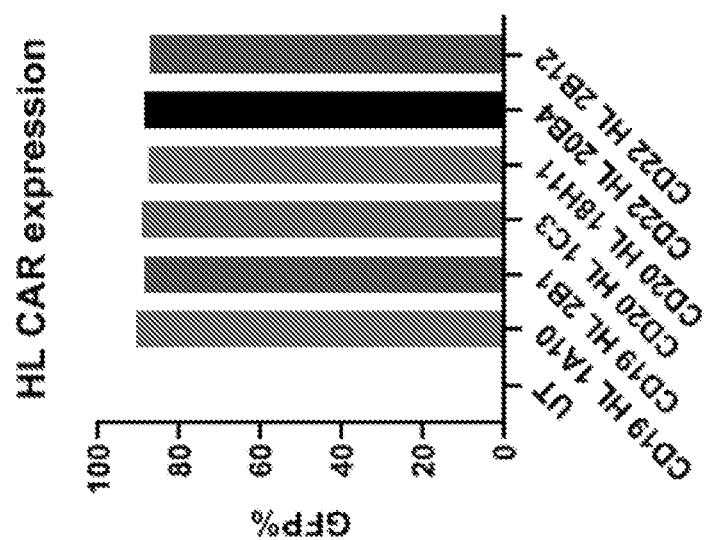
FIG. 2 is a bar graph showing HL CAR expression. CD19-, CD20- or CD22-targeted CAR T cells were produced and CAR expression was analyzed by flow cytometry. GFP % reflects CAR expression. HL, heavy chain in front of light chain orientation for scFv design.

CAR expression in human CAR-T cells. On day 0, human T cells were isolated from healthy donor PBMCs and activated with human CD3/CD28 dynabeads. T cells were spin transduced retrovirally with CARs on day 1 and day 2. On day 3, fresh medium with IL2 were added. On day 4, CAR-T cells were harvested, de-beaded and evaluated by flow cytometry (FIG. 2). All CD19, CD20 or CD22 CARs tested were tagged with GFP. GFP % reflects CAR expression. Hybridoma cell IDs were indicated.

Figure 3:
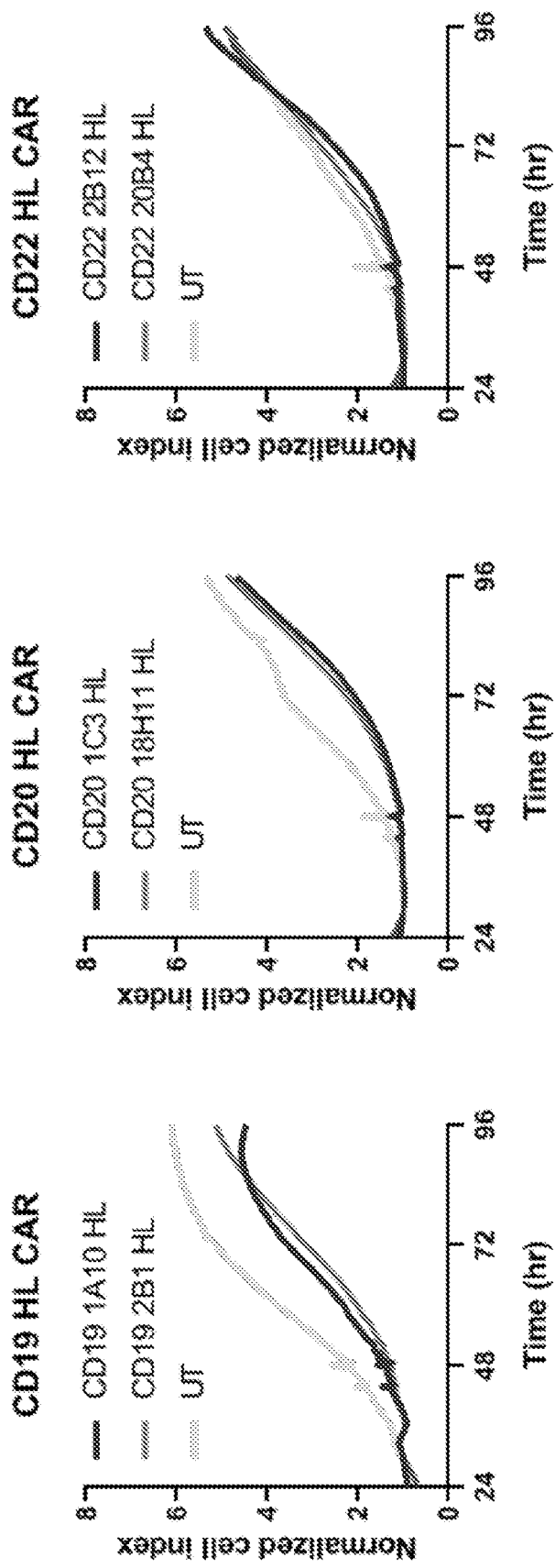
FIG. 3 contains graphs showing CTL with HL CARs. CD19-, CD20- or CD22-targeted CAR T cells were produced and co-cultured with CD19-, CD20- or CD22-expressing target cells at a 10:1 ET ratio. Target cell killing was monitored on an xCELLigence RTCA system. 0:1. Normalized cell index reflects cell growth. UT, untransduced T cell.

Human CAR T cells were produced and co-cultured with target cells at E:T ratio of 10:1. Target cell killing was monitored on an xCELLigence RTCA system (FIG. 3). Normalized cell index reflects cell growth.

Figure 4:
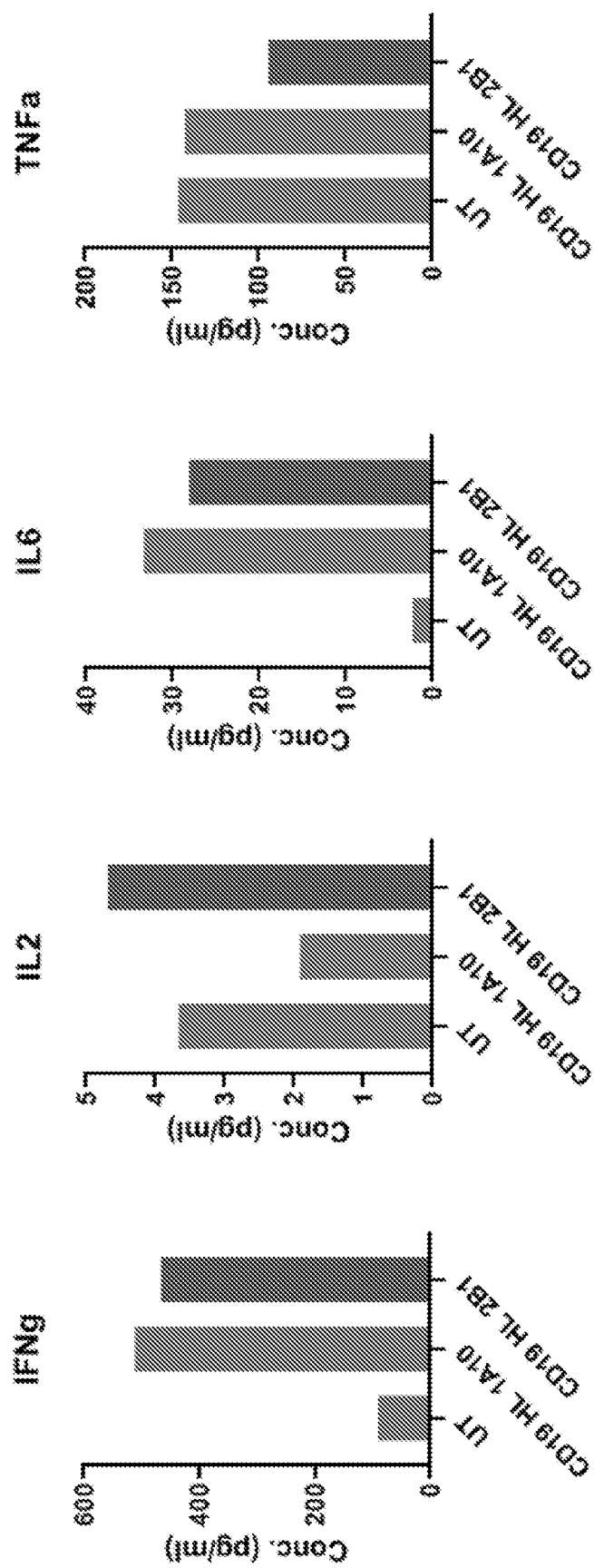
FIG. 4 contains bar graphs showing 24 hour cytokine expression with CD19 HL CAR.
Figure 5:
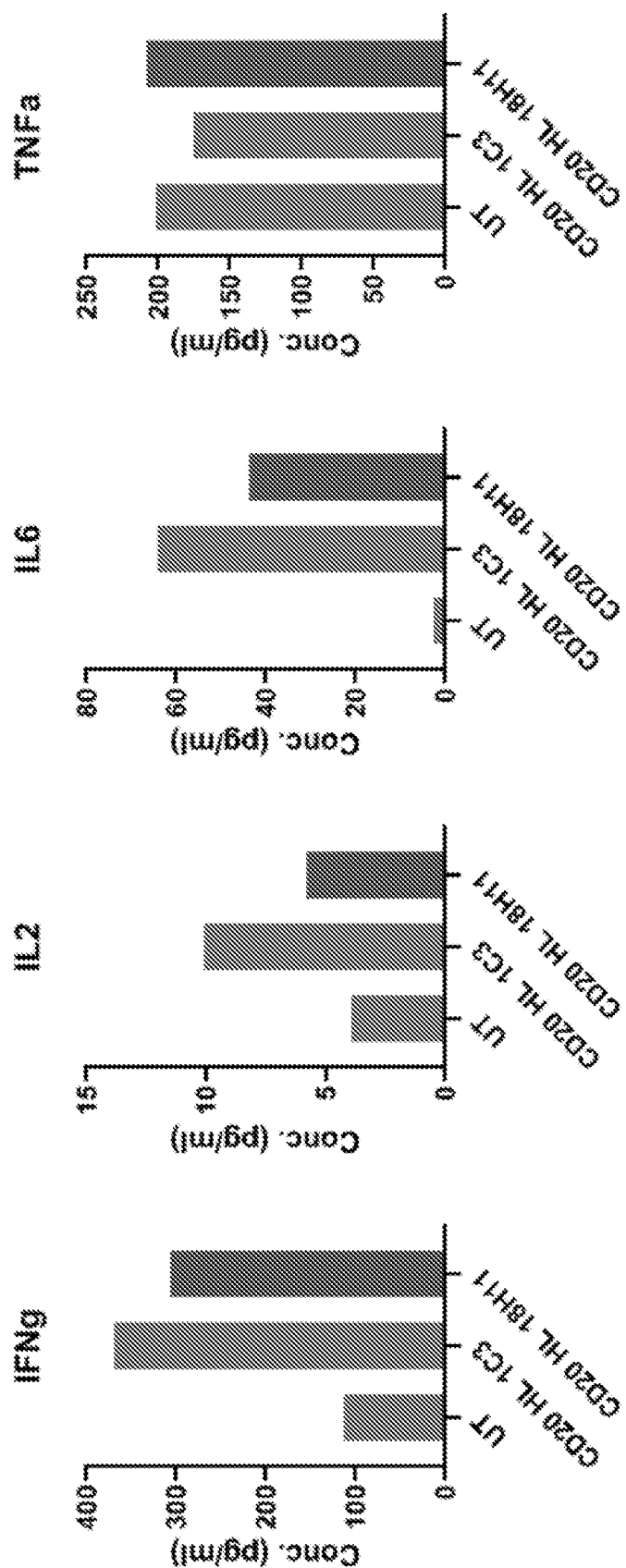
FIG. 5 contains bar graphs showing 24 hour cytokine expression with CD20 HL CAR.
Figure 6:
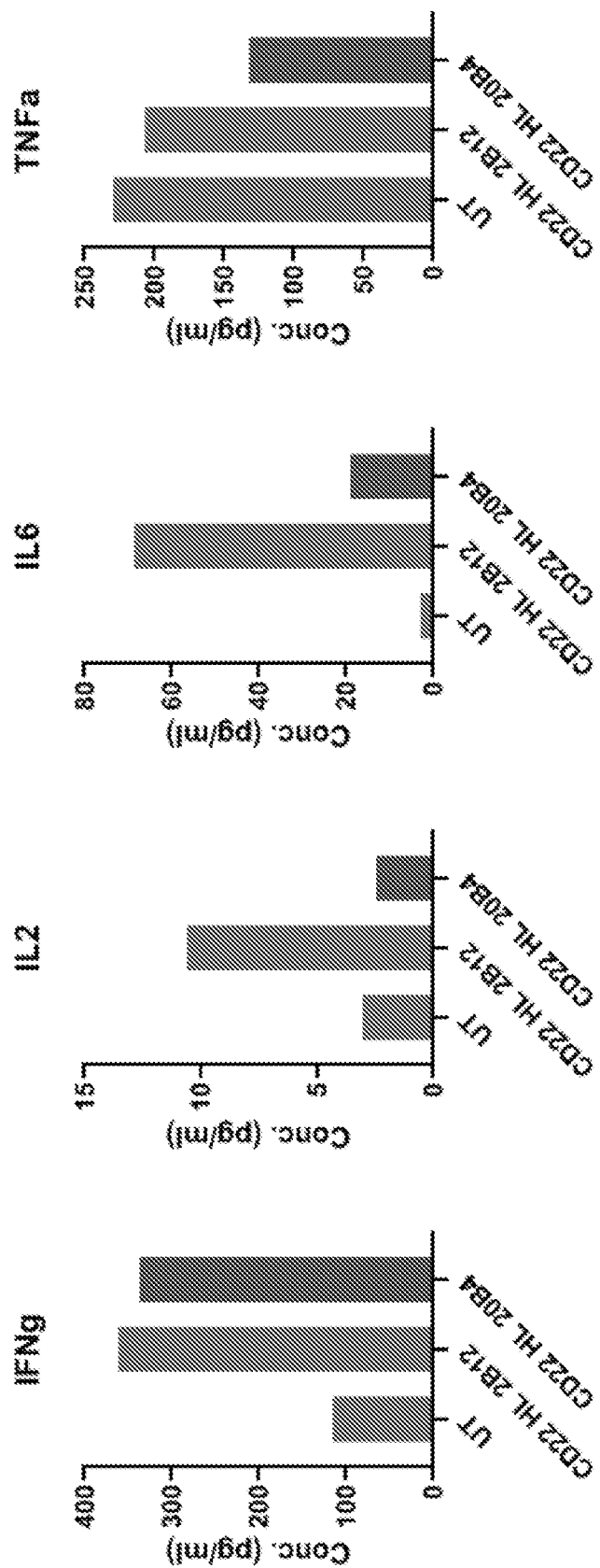
FIG. 6 contains bar graphs showing 24 hour cytokine expression with CD22 HL CAR.

Human CAR T cells were produced and co-cultured with target cells at E:T ratio of 10:1. Twenty-four hours later, supernatant was collected and subjected to ELISA analysis for CD19 (FIG. 4), CD20 (FIG. 5), and CD22 (FIG. 6) using an Ella machine Unless defined otherwise, all technical and scientific terms used herein have the same meanings as commonly understood by one of skill in the art to which the disclosed invention belongs. Publications cited herein and the materials for which they are cited are specifically incorporated by reference.

Those skilled in the art will recognize, or be able to ascertain using no more than routine experimentation, many equivalents to the specific embodiments of the invention described herein. Such equivalents are intended to be encompassed by the following claims.

SEQUENCE LISTING (613 sequences)

SEQ ID NO: 1 - protein, 8 aa, Artificial Sequence
  Synthetic Construct
GFTFSSYA

SEQ ID NO: 2 - protein, 8 aa, Artificial Sequence
  Synthetic Construct
GFSLTNFG

SEQ ID NO: 3 - protein, 8 aa, Artificial Sequence
  Synthetic Construct
GYTFTSYW

SEQ ID NO: 4 - protein, 10 aa, Artificial Sequence
  Synthetic Construct
GISITTGNYR

SEQ ID NO: 5 - protein, 8 aa, Artificial Sequence
  Synthetic Construct
GFTFSRYA

SEQ ID NO: 6 - protein, 9 aa, Artificial Sequence
  Synthetic Construct
GYSITSDYA

SEQ ID NO: 7 - protein, 8 aa, Artificial Sequence
  Synthetic Construct
YTFTDYYY

SEQ ID NO: 8 - protein, 8 aa, Artificial Sequence
  Synthetic Construct
GFSLSRYS

SEQ ID NO: 9 - protein, 7 aa, Artificial Sequence
  Synthetic Construct
ISSGGST

SEQ ID NO: 10 - protein, 8 aa, Artificial Sequence
  Synthetic Construct
ISSGGSFT

SEQ ID NO: 11 - protein, 7 aa, Artificial Sequence
  Synthetic Construct
IWRGGST

SEQ ID NO: 12 - protein, 8 aa, Artificial Sequence
  Synthetic Construct
IAPGTGST

SEQ ID NO: 13 - protein, 7 aa, Artificial Sequence
  Synthetic Construct
IYYSGTI

SEQ ID NO: 14 - protein, 8 aa, Artificial Sequence
  Synthetic Construct
ISPGGGYI

SEQ ID NO: 15 - protein, 7 aa, Artificial Sequence
  Synthetic Construct
ISYSGST

SEQ ID NO: 16 - protein, 8 aa, Artificial Sequence
  Synthetic Construct
IYPNNSGT

SEQ ID NO: 17 - protein, 7 aa, Artificial Sequence
  Synthetic Construct
IWVNGNT

SEQ ID NO: 18 - protein, 8 aa, Artificial Sequence
  Synthetic Construct
IYPGNSDT

SEQ ID NO: 19 - protein, 13 aa, Artificial Sequence
  Synthetic Construct
ARGRDGYSLYFDY

SEQ ID NO: 20 - protein, 15 aa, Artificial Sequence
  Synthetic Construct
AREGVYSDYRAWFAY

SEQ ID NO: 21 - protein, 11 aa, Artificial Sequence
  Synthetic Construct
AKMGITYYFDY

SEQ ID NO: 22 - protein, 12 aa, Artificial Sequence
  Synthetic Construct
AREGGRYYTLDC

SEQ ID NO: 23 - protein, 9 aa, Artificial Sequence
  Synthetic Construct
ARWLNNFDV

SEQ ID NO: 24 - protein, 7 aa, Artificial Sequence
  Synthetic Construct
AGDYVDY

SEQ ID NO: 25 - protein, 10 aa, Artificial Sequence
  Synthetic Construct
ARNWVYAMDY

SEQ ID NO: 26 - protein, 13 aa, Artificial Sequence
  Synthetic Construct
ARYYDGFNAGFAY

SEQ ID NO: 27 - protein, 12 aa, Artificial Sequence
  Synthetic Construct
ATYYGNYDSFTY

SEQ ID NO: 28 - protein, 6 aa, Artificial Sequence
  Synthetic Construct
TTSLAY

SEQ ID NO: 29 - protein, 6 aa, Artificial Sequence
  Synthetic Construct
QNVGTN

SEQ ID NO: 30 - protein, 10 aa, Artificial Sequence
  Synthetic Construct
ETIDNYGISF

SEQ ID NO: 31 - protein, 6 aa, Artificial Sequence
  Synthetic Construct
QNVDTN

SEQ ID NO: 32 - protein, 6 aa, Artificial Sequence
  Synthetic Construct
QDVGTA

SEQ ID NO: 33 - protein, 6 aa, Artificial Sequence
  Synthetic Construct
QDVSTA

SEQ ID NO: 34 - protein, 11 aa, Artificial Sequence
  Synthetic Construct
QSLLNSDGKTF

SEQ ID NO: 35 - protein, 12 aa, Artificial Sequence
  Synthetic Construct
QSLLYSSNQKNY

SEQ ID NO: 36 - protein, 11 aa, Artificial Sequence
  Synthetic Construct
QSLLDSDGKTY

SEQ ID NO: 37 - protein, 7 aa, Artificial Sequence
  Synthetic Construct
SSVSSSY

SEQ ID NO: 38 - protein, 4 aa, Artificial Sequence
  Synthetic Construct
  MISC_FEATURE (1)..(1): Xaa is any amino acid
XSAS

SEQ ID NO: 39 - protein, 4 aa, Artificial Sequence
  Synthetic Construct
  MISC_FEATURE (1)..(1): Xaa is any amino acid
XGAS

SEQ ID NO: 40 - protein, 4 aa, Artificial Sequence
  Synthetic Construct
  MISC_FEATURE (1)..(1): Xaa is any amino acid
XWAS

SEQ ID NO: 41 - protein, 4 aa, Artificial Sequence
  Synthetic Construct
  MISC_FEATURE (1)..(1): Xaa is any amino acid
XLVS

SEQ ID NO: 42 - protein, 4 aa, Artificial Sequence
  Synthetic Construct
  MISC_FEATURE (1)..(1): Xaa is any amino acid
XSTS

SEQ ID NO: 43 - protein, 9 aa, Artificial Sequence
  Synthetic Construct
QQYNTYPYT

SEQ ID NO: 44 - protein, 9 aa, Artificial Sequence
  Synthetic Construct
QQNKEFPWT

SEQ ID NO: 45 - protein, 9 aa, Artificial Sequence
  Synthetic Construct
QQYNSYPLT

SEQ ID NO: 46 - protein, 9 aa, Artificial Sequence
  Synthetic Construct
QQYSSYPLT

SEQ ID NO: 47 - protein, 9 aa, Artificial Sequence
  Synthetic Construct
QQHYSTPYT

SEQ ID NO: 48 - protein, 9 aa, Artificial Sequence
  Synthetic Construct
WQGTHFPYT

SEQ ID NO: 49 - protein, 9 aa, Artificial Sequence
  Synthetic Construct
QQYYSYPRT

SEQ ID NO: 50 - protein, 9 aa, Artificial Sequence
  Synthetic Construct
WQGTHFPHT

SEQ ID NO: 51 - protein, 9 aa, Artificial Sequence
  Synthetic Construct
QQYSGYPLT

SEQ ID NO: 52 - protein, 15 aa, Artificial Sequence
  Synthetic Construct
GGGGSGGGGSGGGGS

SEQ ID NO: 53 - protein, 119 aa, Artificial Sequence
  Synthetic Construct
EVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSS

SEQ ID NO: 54 - protein, 122 aa, Artificial Sequence
  Synthetic Construct
QVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVSG

SEQ ID NO: 55 - protein, 117 aa, Artificial Sequence
  Synthetic Construct
EVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSS

SEQ ID NO: 56 - protein, 119 aa, Artificial Sequence
  Synthetic Construct
QVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSS

SEQ ID NO: 57 - protein, 116 aa, Artificial Sequence
  Synthetic Construct
QVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVS

SEQ ID NO: 58 - protein, 114 aa, Artificial Sequence
  Synthetic Construct
EVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSS

SEQ ID NO: 59 - protein, 117 aa, Artificial Sequence
  Synthetic Construct
QVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSS

SEQ ID NO: 60 - protein, 121 aa, Artificial Sequence
  Synthetic Construct
EVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSA

SEQ ID NO: 61 - protein, 118 aa, Artificial Sequence
  Synthetic Construct
QVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSA

SEQ ID NO: 62 - protein, 113 aa, Artificial Sequence
  Synthetic Construct
EVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSA

SEQ ID NO: 63 - protein, 108 aa, Artificial Sequence
  Synthetic Construct
DIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKR

SEQ ID NO: 64 - protein, 112 aa, Artificial Sequence
  Synthetic Construct
DIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKR

SEQ ID NO: 65 - protein, 108 aa, Artificial Sequence
  Synthetic Construct
DIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKR

SEQ ID NO: 66 - protein, 108 aa, Artificial Sequence
  Synthetic Construct
DIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKR

SEQ ID NO: 67 - protein, 108 aa, Artificial Sequence
  Synthetic Construct
DIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKR

SEQ ID NO: 68 - protein, 113 aa, Artificial Sequence
  Synthetic Construct
DVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 69 - protein, 114 aa, Artificial Sequence
  Synthetic Construct
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 70 - protein, 114 aa, Artificial Sequence
  Synthetic Construct
DIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 71 - protein, 113 aa, Artificial Sequence
  Synthetic Construct
DIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 72 - protein, 109 aa, Artificial Sequence
  Synthetic Construct
DIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 73 - DNA, 357 bp, Artificial Sequence
  Synthetic Construct
gaagtgaagctggaggagtctgggggaggcttagtgaagcctggagggtccctgaaactctcctgtgcagcctctggattcactttcagtagctatgccatgtcttgggttcgccagactccagagaagaggctggagtgggtcgcatccattagtagtggtggtagcacctactatcctgacagtgtgaagggccgattcaccatctccagagataatgccaggaacaccctgtacctgcaaatgagcagtctgaggtctgaggacacggccatgtattactgtgcaagaggccgggatggttactccctttactttgactactggggccaaggcaccactctcacagtctcctca

SEQ ID NO: 74 - DNA, 366 bp, Artificial Sequence
  Synthetic Construct
caagtcaagctgcaggagtctgggggaggcttagtgaagcctggagggtccctgaaactctcctgtgcagcctctggattcactttcagtagttatgccatgtcttgggttcgccagactccggagaagaggctggagtgggtcgcagggattagtagtggtggtagtttcacttactatccagacactgtgaagggacgattcaccatttccagagacaatgccaggaacaccctttacctgcaaatgagcagtctgaggtctgaggacacggccatgtattcctgtgcaagagaaggggtctatagtgactacagggcctggtttgcttactggggccaagggactctggtcactgtctctgga

SEQ ID NO: 75 - DNA, 351 bp, Artificial Sequence
  Synthetic Construct
gaggtaaagctggagcagtcaggacctagcctagtgcagccctcacagagcctgtccataacctgcacagtctctggtttctcattaactaactttggtgtacactgggttcgccagtctccaggaaagggtctggagtggctgggactgatatggagaggtggaagcacagactacaatgcagctttcatgtccagactgagcatcaccaaggacaactccaagagccaagttttctttaaaatgaacagtctgcaagctgatgacactgccatatactactgtgccaaaatggggattacgtactactttgactactggggccaaggcaccactctcacagtctcctca

SEQ ID NO: 76 - DNA, 357 bp, Artificial Sequence
  Synthetic Construct
caggtaaagctgcagcagtctggagatgatctggtaaagcctggggcctcagtgaagctgtcctgcaaggcttctggctacaccttcaccagctactggattaactggataaaacagaggcctggacagggccttgagtggataggacatattgctcctggaactggtagtacttactacagtgaaatgttcaaggacaaggcaacactgactgtagacacaccctccagctcagcctacattcagctcagcagcctgtcatctgaggactctgctgtctatttctgtgcaagagaggggggacgatactatactttggactgctggggtcaaggaacctcagtcaccgtctcctca

SEQ ID NO: 77 - DNA, 351 bp, Artificial Sequence
  Synthetic Construct
caggtgcagctggaggagtcaggacctggtctggtgaaaccttctcagacagtgtccctcacctgcactgtcactggcatctccatcaccactggaaattacagatggagctggatccggcagtttccaggaaacaaactggagtggatagggtacatatactacagtggtaccattacctacaatccatctctcacaagtcgaaccaccatcactagagacacttccaagaaccaattcttcctggaaatgaactctttgactgctgaagacacagccacatactactgtgcacgatggttaaacaacttcgatgtctggggcacagggaccacggtcaccgtctcctca

SEQ ID NO: 78 - DNA, 342 bp, Artificial Sequence
  Synthetic Construct
gaagtgatgctggtggaatctgggggaggcttagtgaagcctggagggtccctgaaactctcctgtgcagcctctggattcactttcagtaggtatgccatgtcttggaatcgccagactccggagaagaggctggagtgggtcgcaacaattagtcctggtggtggttacatatactattcagacagtgtgaaggggcgattcaccatctccagagacaatgccaggaacaccctgtatctgcaaatgagcagtctgaggtctgaggacacggccatgtattactgtgcaggggactatgttgactattggggccaaggcaccactctcacagtctcctca

SEQ ID NO: 79 - DNA, 351 bp, Artificial Sequence
  Synthetic Construct
caagttcagctgcaggagtcgggacctggcctggtaaaaccttctcagtctctgtccctcacctgcactgtcactggctactcaatcaccagtgattatgcctggaactggatccggcagtttccaggaaacaaactggagtggatgggctacataagctacagtggtagcactacctacaacccatctctcaaaggtcgaatctctttcactcgagacacctccaagaaccagttcttcctgcacttgaaatctgtgactactgaggactcagccacatattactgtgcaagaaactgggtctatgctatggactactggggtcaaggaacctcagtcaccgtctcctca

SEQ ID NO: 80 - DNA, 363 bp, Artificial Sequence
  Synthetic Construct
gaggtaaagctgcagcagtctggacctgtactggtgaagcctggggcttcagtgaagatatcctgcaaggcttctggatacacattcactgactactactacatgaattgggtgaagcagagccatggaaagagccttgagtggattggatatatttatcctaacaatagtggtactagttacaaccagaagttcaggggcaaggccacattgactgttgacaagtcctccagcacagcctacatggaggtccgcagcctgacatctgaggattctgcagtctattactgtgcgagatactatgatggtttcaacgccgggtttgcttactggggccaagggactctggtcactgtctctgca

SEQ ID NO: 81 - DNA, 354 bp, Artificial Sequence
  Synthetic Construct
caagtgcagctggaggagtcaggacctggcctggtggcaccctcacagagcctgtccatcacatgcactgtctctgggttctcattatccagatatagtgtacactgggttcgccagcctccaggaaagggtctggaatggctgggaatgatatgggttaatggaaacacagactataattcagctctcaaatccagacttaacatcaacaaggacaactccaagagccaagttttcttaaaaatgaacagtctgcaaactgatgacacagccatgtactattgtgccacctattatggaaactacgattcctttacttactggggccaggggactctggtcactgtctctgca

SEQ ID NO: 82 - DNA, 339 bp, Artificial Sequence
  Synthetic Construct
gaggtgcagctgcaggagtctggggctgagctggcaagacctggggcttcagtgaagatgtcctgcaaggcttctggctacacctttaccagctactggatgcactgggtaaaacagaggcctggacagggtctggaatggattggcgctatttatcctggaaatagtgatactagctacaatcagaagttcaagggcaaggccaaactgactgcagtcacatccgccagcactgcctacatggagctcagcagcctaacaaatgaggactctgcggtctattactgtacaacctcccttgcttactggggccaagggactctggtcactgtctctgca

SEQ ID NO: 83 - DNA, 324 bp, Artificial Sequence
  Synthetic Construct
gatattgtgctgacccaatctcacaaattcatgtccacatcagttggagacagggtcagcgtcacctgcaaggccagtcagaatgtgggtactaatgtagcctggtatcaacagaaaccagggcaatctcctaaagcactgattttctcggcatcctaccggaacagtggagtccctgatcgcttcacaggcagtggatctgggacagatttcactctcaccatcaccaatgtgcagtctgaagacttgttagagtatttctgtcagcaatataacacctatccgtacacgttcggaggggggaccaagctggaaataaaacgg

SEQ ID NO: 84 - DNA, 336 bp, Artificial Sequence
  Synthetic Construct
gatattgtgatgacccaatctccagcttctttggctgtgtctctaggacagagggccaccatctcctgcagagccagcgaaactattgataattatggcattagttttatgaactggttccaacagaaaccaggacagccacccaagctcctcatctatggtgcatccaaccaaggatccggggtccctgccaggtttagtggcagtgggtctgggacagacttcagcctcaacatccatcctatggaggaggatgatactgcaatgtatttctgtcagcaaaataaggaatttccgtggacgttcggtggaggcaccaagctggaaatcaaacgg

SEQ ID NO: 85 - DNA, 324 bp, Artificial Sequence
  Synthetic Construct
gacattgtgatgacccaatctcacaaattcatgtccacatcagtaggaggcagggtcagtgtcacctgcaaggccagtcagaatgtggatactaatgtagcctggtatcaacagaaaccagggcaatctcctaaagcactgatttactcggcatcgtaccggtacagtggagtccctgatcgcttcacaggcagtggatctgggacagatttcactctcaccatcactaatgtgcagtctgaagacttggcagagtatttctgtcagcaatataacagctatccgctcacgttcggtgctgggaccaagctggagctgaaacgg

SEQ ID NO: 86 - DNA, 324 bp, Artificial Sequence
  Synthetic Construct
gacattgtgctcacacagactcacaaattcatgtccacatcagtaggagacagggtcagcatcacctgcaaggccagtcaggatgtgggtactgctgtagcctggtatcaacagaaaccagggcaatctcctaaactactgatttactgggcatccacccggcacactggagtccctgatcgcttcacaggcagtggatctgggacagatttcactctcaccattagcaatgtgcagtctgaagacttggcagattatttctgtcagcaatatagcagctatcctctcacgttcggaggggggaccaagctggaaataaaacgg

SEQ ID NO: 87 - DNA, 324 bp, Artificial Sequence
  Synthetic Construct
gacattgtgatcacacaatctcacaaattcatgcccacatcagtaggagacagggtcagcatcacctgcaaggccagtcaggatgtgagtactgctgtagcctggtatcaacagaaaccaggacaatctcctaaactactgatttactcggcatcctaccggtacactggagtccctgatcgcttcactggcagtggatctgggacggatttcactttcaccatcagcagtgtgcaggctgaagacctggcagtttattactgtcagcaacattatagtactccgtacacgttcggaggggggaccaagctggaaataaaacgg

SEQ ID NO: 88 - DNA, 339 bp, Artificial Sequence
  Synthetic Construct
gatgttgtgatgacccagactccactcactttgtcggttaccactggacaaccagcctccatctcttgcaagtcaagtcagagcctcttaaatagtgatggaaagacatttttgaattggttgttacagaggccagggcagtctccaaagcgcctaatctatctggtgtctaaactggactctggagtccctgacaggttcactggcagtggatcagggacagatttcacactgaaaatctgcagagtggaggctgaggatttgggagtttattattgctggcaaggtacacattttccatacacgttcggaggggggaccaagctggaaataaaacgg

SEQ ID NO: 89 - DNA, 342 bp, Artificial Sequence
  Synthetic Construct
gacattgtgatgtcacagtctccatcctccctagctgtgtcagttggagagaaggttactatgagctgcaagtccagtcagagccttttatatagtagcaatcaaaagaactacttggcctggtaccagcagaaaccagggcagtctcctaaactgctgatttactgggcatccactagggaatctggggtccctgatcgcttcacaggcagtggatctgggacagatttcactctcaccatcagcagtgtgaaggctgaagacctggcagtttattactgtcagcaatattatagctatcctcggacgttcggtggaggcaccaagctggaaatcaaacgg

SEQ ID NO: 90 - DNA, 342 bp, Artificial Sequence
  Synthetic Construct
gacattgtgctgacccaatctacatcctccctagctgtgtcagttggagagaaggttactatgagctgcaagtccagtcagagccttttatttggtagcaatcaaaagaactacttggcctggtaccagcagaaattagggcagtctcctaaactactaattttctgggcatccactagggaatctggggtccctgatcgcttcacaggcagtggatctgggacagatttcactctcaccatcagcagtgtgaaggctgaagacctggcagtttattactgtcagcaatattatagctatccattcacgttcggctcggggacaaagttggaaataaaacgg

SEQ ID NO: 91 - DNA, 339 bp, Artificial Sequence
  Synthetic Construct
gatattgtgctcacccagactaacctcactttgtcgattaccattggacaaccagcctccatctcttgcaagtcaagtcagagcctcttagatagtgatggaaagacatatttgaattggttgttacagaggccaggccagtctccaaagcgcctaatctatctggtgtctaaactggactctggagtccctgacaggttcactggcagtggatcagggacagatttcacactgaaaatcagcagagtgggggctgaggatttgggaatttattattgctggcaaggtacacattttcctcacacgttcggaggggggaccaagctggaaataaaacgg

SEQ ID NO: 92 - DNA, 327 bp, Artificial Sequence
  Synthetic Construct
gatattgtgctgacccagtctccagcaatcatgtctgcatctccaggggaaaaggtcaccatgacctgcagggccagctcaagtgtaagttccagttacttgcactggtaccagcagaagtcaggtgcctcccccaaactctggatttatagcacatccaacttggcttctggagtccctgctcgcttcagtggcagtgggtctgggacctcttactctctcacaatcagcagtgtggaggctgaagatgctgccacttattactgccagcagtacagtggttacccactcacgttcggtgctgggaccaagctggagctgaaacgg

SEQ ID NO: 93 - protein, 242 aa, Artificial Sequence
  Synthetic Construct
EVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSSGGGGSGGGGSGGGGSDIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKR

SEQ ID NO: 94 - protein, 245 aa, Artificial Sequence
  Synthetic Construct
EVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSSGGGGSGGGGSGGGGSDIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIK

SEQ ID NO: 95 - protein, 242 aa, Artificial Sequence
  Synthetic Construct
EVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSSGGGGSGGGGSGGGGSDIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKR

SEQ ID NO: 96 - protein, 242 aa, Artificial Sequence
  Synthetic Construct
EVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSSGGGGSGGGGSGGGGSDIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKR

SEQ ID NO: 97 - protein, 242 aa, Artificial Sequence
  Synthetic Construct
EVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSSGGGGSGGGGSGGGGSDIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKR

SEQ ID NO: 98 - protein, 247 aa, Artificial Sequence
  Synthetic Construct
EVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSSGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 99 - protein, 248 aa, Artificial Sequence
  Synthetic Construct
EVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSSGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 100 - protein, 248 aa, Artificial Sequence
  Synthetic Construct
EVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSSGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 101 - protein, 247 aa, Artificial Sequence
  Synthetic Construct
EVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSSGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 102 - protein, 243 aa, Artificial Sequence
  Synthetic Construct
EVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSSGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 103 - protein, 245 aa, Artificial Sequence
  Synthetic Construct
QVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVSGGGGGSGGGGSGGGGSDIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKR

SEQ ID NO: 104 - protein, 248 aa, Artificial Sequence
  Synthetic Construct
QVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVSGGGGGSGGGGSGGGGSDIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIK

SEQ ID NO: 105 - protein, 245 aa, Artificial Sequence
  Synthetic Construct
QVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVSGGGGGSGGGGSGGGGSDIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKR

SEQ ID NO: 106 - protein, 245 aa, Artificial Sequence
  Synthetic Construct
QVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVSGGGGGSGGGGSGGGGSDIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKR

SEQ ID NO: 107 - protein, 245 aa, Artificial Sequence
  Synthetic Construct
QVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVSGGGGGSGGGGSGGGGSDIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKR

SEQ ID NO: 108 - protein, 250 aa, Artificial Sequence
  Synthetic Construct
QVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVSGGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 109 - protein, 251 aa, Artificial Sequence
  Synthetic Construct
QVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVSGGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 110 - protein, 251 aa, Artificial Sequence
  Synthetic Construct
QVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVSGGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 111 - protein, 250 aa, Artificial Sequence
  Synthetic Construct
QVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVSGGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 112 - protein, 246 aa, Artificial Sequence
  Synthetic Construct
QVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVSGGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 113 - protein, 240 aa, Artificial Sequence
  Synthetic Construct
EVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSSGGGGSGGGGSGGGGSDIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKR

SEQ ID NO: 114 - protein, 243 aa, Artificial Sequence
  Synthetic Construct
EVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSSGGGGSGGGGSGGGGSDIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIK

SEQ ID NO: 115 - protein, 240 aa, Artificial Sequence
  Synthetic Construct
EVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSSGGGGSGGGGSGGGGSDIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKR

SEQ ID NO: 116 - protein, 240 aa, Artificial Sequence
  Synthetic Construct
EVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSSGGGGSGGGGSGGGGSDIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKR

SEQ ID NO: 117 - protein, 240 aa, Artificial Sequence
  Synthetic Construct
EVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSSGGGGSGGGGSGGGGSDIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKR

SEQ ID NO: 118 - protein, 245 aa, Artificial Sequence
  Synthetic Construct
EVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSSGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 119 - protein, 246 aa, Artificial Sequence
  Synthetic Construct
EVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSSGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 120 - protein, 246 aa, Artificial Sequence
  Synthetic Construct
EVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSSGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 121 - protein, 245 aa, Artificial Sequence
  Synthetic Construct
EVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSSGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 122 - protein, 241 aa, Artificial Sequence
  Synthetic Construct
EVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSSGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 123 - protein, 242 aa, Artificial Sequence
  Synthetic Construct
QVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSSGGGGSGGGGSGGGGSDIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKR

SEQ ID NO: 124 - protein, 245 aa, Artificial Sequence
  Synthetic Construct
QVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSSGGGGSGGGGSGGGGSDIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIK

SEQ ID NO: 125 - protein, 242 aa, Artificial Sequence
  Synthetic Construct
QVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSSGGGGSGGGGSGGGGSDIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKR

SEQ ID NO: 126 - protein, 242 aa, Artificial Sequence
  Synthetic Construct
QVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSSGGGGSGGGGSGGGGSDIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKR

SEQ ID NO: 127 - protein, 242 aa, Artificial Sequence
  Synthetic Construct
QVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSSGGGGSGGGGSGGGGSDIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKR

SEQ ID NO: 128 - protein, 247 aa, Artificial Sequence
  Synthetic Construct
QVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSSGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 129 - protein, 248 aa, Artificial Sequence
  Synthetic Construct
QVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSSGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 130 - protein, 248 aa, Artificial Sequence
  Synthetic Construct
QVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSSGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 131 - protein, 247 aa, Artificial Sequence
  Synthetic Construct
QVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSSGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 132 - protein, 243 aa, Artificial Sequence
  Synthetic Construct
QVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSSGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 133 - protein, 239 aa, Artificial Sequence
  Synthetic Construct
QVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVSGGGGSGGGGSGGGGSDIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKR

SEQ ID NO: 134 - protein, 242 aa, Artificial Sequence
  Synthetic Construct
QVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVSGGGGSGGGGSGGGGSDIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIK

SEQ ID NO: 135 - protein, 239 aa, Artificial Sequence
  Synthetic Construct
QVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVSGGGGSGGGGSGGGGSDIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKR

SEQ ID NO: 136 - protein, 239 aa, Artificial Sequence
  Synthetic Construct
QVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVSGGGGSGGGGSGGGGSDIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKR

SEQ ID NO: 137 - protein, 239 aa, Artificial Sequence
  Synthetic Construct
QVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVSGGGGSGGGGSGGGGSDIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKR

SEQ ID NO: 138 - protein, 244 aa, Artificial Sequence
  Synthetic Construct
QVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVSGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 139 - protein, 245 aa, Artificial Sequence
  Synthetic Construct
QVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVSGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 140 - protein, 245 aa, Artificial Sequence
  Synthetic Construct
QVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVSGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 141 - protein, 244 aa, Artificial Sequence
  Synthetic Construct
QVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVSGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 142 - protein, 240 aa, Artificial Sequence
  Synthetic Construct
QVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVSGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 143 - protein, 237 aa, Artificial Sequence
  Synthetic Construct
EVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSSGGGGSGGGGSGGGGSDIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKR

SEQ ID NO: 144 - protein, 241 aa, Artificial Sequence
  Synthetic Construct
EVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSSGGGGSGGGGSGGGGSDIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKR

SEQ ID NO: 145 - protein, 237 aa, Artificial Sequence
  Synthetic Construct
EVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSSGGGGSGGGGSGGGGSDIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKR

SEQ ID NO: 146 - protein, 237 aa, Artificial Sequence
  Synthetic Construct
EVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSSGGGGSGGGGSGGGGSDIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKR

SEQ ID NO: 147 - protein, 237 aa, Artificial Sequence
  Synthetic Construct
EVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSSGGGGSGGGGSGGGGSDIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKR

SEQ ID NO: 148 - protein, 242 aa, Artificial Sequence
  Synthetic Construct
EVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSSGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 149 - protein, 243 aa, Artificial Sequence
  Synthetic Construct
EVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSSGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 150 - protein, 243 aa, Artificial Sequence
  Synthetic Construct
EVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSSGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 151 - protein, 242 aa, Artificial Sequence
  Synthetic Construct
EVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSSGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 152 - protein, 238 aa, Artificial Sequence
  Synthetic Construct
EVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSSGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 153 - protein, 240 aa, Artificial Sequence
  Synthetic Construct
QVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSSGGGGSGGGGSGGGGSDIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKR

SEQ ID NO: 154 - protein, 244 aa, Artificial Sequence
  Synthetic Construct
QVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSSGGGGSGGGGSGGGGSDIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKR

SEQ ID NO: 155 - protein, 240 aa, Artificial Sequence
  Synthetic Construct
QVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSSGGGGSGGGGSGGGGSDIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKR

SEQ ID NO: 156 - protein, 240 aa, Artificial Sequence; identical to SEQ ID NO: 153
  Synthetic Construct

SEQ ID NO: 157 - protein, 240 aa, Artificial Sequence
  Synthetic Construct
QVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSSGGGGSGGGGSGGGGSDIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKR

SEQ ID NO: 158 - protein, 245 aa, Artificial Sequence
  Synthetic Construct
QVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSSGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 159 - protein, 246 aa, Artificial Sequence
  Synthetic Construct
QVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSSGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 160 - protein, 246 aa, Artificial Sequence
  Synthetic Construct
QVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSSGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 161 - protein, 245 aa, Artificial Sequence
  Synthetic Construct
QVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSSGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 162 - protein, 241 aa, Artificial Sequence
  Synthetic Construct
QVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSSGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 163 - protein, 244 aa, Artificial Sequence
  Synthetic Construct
EVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSAGGGGSGGGGSGGGGSDIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKR

SEQ ID NO: 164 - protein, 248 aa, Artificial Sequence
  Synthetic Construct
EVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSAGGGGSGGGGSGGGGSDIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKR

SEQ ID NO: 165 - protein, 244 aa, Artificial Sequence
  Synthetic Construct
EVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSAGGGGSGGGGSGGGGSDIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKR

SEQ ID NO: 166 - protein, 244 aa, Artificial Sequence; identical to SEQ ID NO: 163
  Synthetic Construct

SEQ ID NO: 167 - protein, 244 aa, Artificial Sequence
  Synthetic Construct
EVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSAGGGGSGGGGSGGGGSDIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKR

SEQ ID NO: 168 - protein, 249 aa, Artificial Sequence
  Synthetic Construct
EVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSAGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 169 - protein, 250 aa, Artificial Sequence
  Synthetic Construct
EVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSAGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 170 - protein, 250 aa, Artificial Sequence
  Synthetic Construct
EVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSAGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 171 - protein, 249 aa, Artificial Sequence
  Synthetic Construct
EVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSAGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 172 - protein, 245 aa, Artificial Sequence
  Synthetic Construct
EVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSAGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 173 - protein, 241 aa, Artificial Sequence
  Synthetic Construct
QVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSAGGGGSGGGGSGGGGSDIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKR

SEQ ID NO: 174 - protein, 245 aa, Artificial Sequence
  Synthetic Construct
QVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSAGGGGSGGGGSGGGGSDIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKR

SEQ ID NO: 175 - protein, 241 aa, Artificial Sequence
  Synthetic Construct
QVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSAGGGGSGGGGSGGGGSDIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKR

SEQ ID NO: 176 - protein, 241 aa, Artificial Sequence; identical to SEQ ID NO: 173
  Synthetic Construct

SEQ ID NO: 177 - protein, 241 aa, Artificial Sequence
  Synthetic Construct
QVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSAGGGGSGGGGSGGGGSDIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKR

SEQ ID NO: 178 - protein, 246 aa, Artificial Sequence
  Synthetic Construct
QVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSAGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 179 - protein, 247 aa, Artificial Sequence
  Synthetic Construct
QVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSAGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 180 - protein, 247 aa, Artificial Sequence
  Synthetic Construct
QVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSAGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 181 - protein, 246 aa, Artificial Sequence
  Synthetic Construct
QVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSAGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 182 - protein, 242 aa, Artificial Sequence
  Synthetic Construct
QVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSAGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 183 - protein, 236 aa, Artificial Sequence
  Synthetic Construct
EVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSAGGGGSGGGGSGGGGSDIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKR

SEQ ID NO: 184 - protein, 240 aa, Artificial Sequence
  Synthetic Construct
EVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSAGGGGSGGGGSGGGGSDIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKR

SEQ ID NO: 185 - protein, 236 aa, Artificial Sequence
  Synthetic Construct
EVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSAGGGGSGGGGSGGGGSDIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKR

SEQ ID NO: 186 - protein, 236 aa, Artificial Sequence; identical to SEQ ID NO: 183
  Synthetic Construct

SEQ ID NO: 187 - protein, 236 aa, Artificial Sequence
  Synthetic Construct
EVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSAGGGGSGGGGSGGGGSDIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKR

SEQ ID NO: 188 - protein, 241 aa, Artificial Sequence
  Synthetic Construct
EVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSAGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 189 - protein, 242 aa, Artificial Sequence
  Synthetic Construct
EVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSAGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 190 - protein, 242 aa, Artificial Sequence
  Synthetic Construct
EVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSAGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 191 - protein, 241 aa, Artificial Sequence
  Synthetic Construct
EVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSAGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 192 - protein, 237 aa, Artificial Sequence
  Synthetic Construct
EVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSAGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 193 - protein, 242 aa, Artificial Sequence
  Synthetic Construct
DIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKRGGGGSGGGGSGGGGSEVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSS

SEQ ID NO: 194 - protein, 242 aa, Artificial Sequence
  Synthetic Construct
DIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKRGGGGSGGGGSGGGGSQVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVT

SEQ ID NO: 195 - protein, 240 aa, Artificial Sequence
  Synthetic Construct
DIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKRGGGGSGGGGSGGGGSEVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSS

SEQ ID NO: 196 - protein, 242 aa, Artificial Sequence
  Synthetic Construct
DIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKRGGGGSGGGGSGGGGSQVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSS

SEQ ID NO: 197 - protein, 239 aa, Artificial Sequence
  Synthetic Construct
DIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKRGGGGSGGGGSGGGGSQVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVS

SEQ ID NO: 198 - protein, 236 aa, Artificial Sequence
  Synthetic Construct
DIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKRGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 199 - protein, 237 aa, Artificial Sequence
  Synthetic Construct
DIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKRGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 200 - protein, 237 aa, Artificial Sequence
  Synthetic Construct
DIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKRGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 201 - protein, 236 aa, Artificial Sequence
  Synthetic Construct
DIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKRGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 202 - protein, 232 aa, Artificial Sequence
  Synthetic Construct
DIVLTQSHKFMSTSVGDRVSVTCKASQNVGTNVAWYQQKPGQSPKALIFSASYRNSGVPDRFTGSGSGTDFTLTITNVQSEDLLEYFCQQYNTYPYTFGGGTKLEIKRGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 203 - protein, 246 aa, Artificial Sequence
  Synthetic Construct
DIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKRGGGGSGGGGSGGGGSEVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSS

SEQ ID NO: 204 - protein, 246 aa, Artificial Sequence
  Synthetic Construct
DIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKRGGGGSGGGGSGGGGSQVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVT

SEQ ID NO: 205 - protein, 243 aa, Artificial Sequence
  Synthetic Construct
DIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKRGGGSGGGGSGGGGSEVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSS

SEQ ID NO: 206 - protein, 246 aa, Artificial Sequence
  Synthetic Construct
DIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKRGGGGSGGGGSGGGGSQVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSS

SEQ ID NO: 207 - protein, 243 aa, Artificial Sequence
  Synthetic Construct
DIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKRGGGGSGGGGSGGGGSQVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVS

SEQ ID NO: 208 - protein, 240 aa, Artificial Sequence
  Synthetic Construct
DIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKRGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 209 - protein, 241 aa, Artificial Sequence
  Synthetic Construct
DIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKRGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 210 - protein, 241 aa, Artificial Sequence
  Synthetic Construct
DIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKRGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 211 - protein, 240 aa, Artificial Sequence
  Synthetic Construct
DIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKRGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 212 - protein, 236 aa, Artificial Sequence
  Synthetic Construct
DIVMTQSPASLAVSLGQRATISCRASETIDNYGISFMNWFQQKPGQPPKLLIYGASNQGSGVPARFSGSGSGTDFSLNIHPMEEDDTAMYFCQQNKEFPWTFGGGTKLEIKRGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 213 - protein, 242 aa, Artificial Sequence
  Synthetic Construct
DIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKRGGGGSGGGGSGGGGSEVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSS

SEQ ID NO: 214 - protein, 242 aa, Artificial Sequence
  Synthetic Construct
DIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKRGGGGSGGGGSGGGGSQVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVT

SEQ ID NO: 215 - protein, 240 aa, Artificial Sequence
  Synthetic Construct
DIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKRGGGGSGGGGSGGGGSEVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSS

SEQ ID NO: 216 - protein, 242 aa, Artificial Sequence
  Synthetic Construct
DIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKRGGGGSGGGGSGGGGSQVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSS

SEQ ID NO: 217 - protein, 239 aa, Artificial Sequence
  Synthetic Construct
DIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKRGGGGSGGGGSGGGGSQVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVS

SEQ ID NO: 218 - protein, 236 aa, Artificial Sequence
  Synthetic Construct
DIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKRGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 219 - protein, 237 aa, Artificial Sequence
  Synthetic Construct
DIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKRGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 220 - protein, 237 aa, Artificial Sequence
  Synthetic Construct
DIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKRGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 221 - protein, 236 aa, Artificial Sequence
  Synthetic Construct
DIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKRGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 222 - protein, 232 aa, Artificial Sequence
  Synthetic Construct
DIVMTQSHKFMSTSVGGRVSVTCKASQNVDTNVAWYQQKPGQSPKALIYSASYRYSGVPDRFTGSGSGTDFTLTITNVQSEDLAEYFCQQYNSYPLTFGAGTKLELKRGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 223 - protein, 241 aa, Artificial Sequence
  Synthetic Construct
DIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKGGGGSGGGGSGGGGSEVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSS

SEQ ID NO: 224 - protein, 241 aa, Artificial Sequence
  Synthetic Construct
DIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKGGGGSGGGGSGGGGSQVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVT

SEQ ID NO: 225 - protein, 239 aa, Artificial Sequence
  Synthetic Construct
DIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKGGGGSGGGGSGGGGSEVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSS

SEQ ID NO: 226 - protein, 241 aa, Artificial Sequence
  Synthetic Construct
DIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKGGGGSGGGGSGGGGSQVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSS

SEQ ID NO: 227 - protein, 238 aa, Artificial Sequence
  Synthetic Construct
DIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKGGGGSGGGGSGGGGSQVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVS

SEQ ID NO: 228 - protein, 235 aa, Artificial Sequence
  Synthetic Construct
DIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 229 - protein, 236 aa, Artificial Sequence
  Synthetic Construct
DIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 230 - protein, 236 aa, Artificial Sequence
  Synthetic Construct
DIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 231 - protein, 235 aa, Artificial Sequence
  Synthetic Construct
DIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 232 - protein, 231 aa, Artificial Sequence
  Synthetic Construct
DIVLTQTHKFMSTSVGDRVSITCKASQDVGTAVAWYQQKPGQSPKLLIYWASTRHTGVPDRFTGSGSGTDFTLTISNVQSEDLADYFCQQYSSYPLTFGGGTKLEIKGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 233 - protein, 242 aa, Artificial Sequence
  Synthetic Construct
DIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKRGGGGSGGGGSGGGGSEVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSS

SEQ ID NO: 234 - protein, 242 aa, Artificial Sequence
  Synthetic Construct
DIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKRGGGGSGGGGSGGGGSQVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVT

SEQ ID NO: 235 - protein, 240 aa, Artificial Sequence
  Synthetic Construct
DIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKRGGGGSGGGGSGGGGSEVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSS

SEQ ID NO: 236 - protein, 242 aa, Artificial Sequence
  Synthetic Construct
DIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKRGGGGSGGGGSGGGGSQVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSS

SEQ ID NO: 237 - protein, 239 aa, Artificial Sequence
  Synthetic Construct
DIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKRGGGGSGGGGSGGGGSQVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVS

SEQ ID NO: 238 - protein, 236 aa, Artificial Sequence
  Synthetic Construct
DIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKRGGGGSGGGGSGGGGSDVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKR

SEQ ID NO: 239 - protein, 237 aa, Artificial Sequence
  Synthetic Construct
DIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKRGGGGSGGGGSGGGGSDIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKR

SEQ ID NO: 240 - protein, 237 aa, Artificial Sequence
  Synthetic Construct
DIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKRGGGGSGGGGSGGGGSDIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKR

SEQ ID NO: 241 - protein, 236 aa, Artificial Sequence
  Synthetic Construct
DIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKRGGGGSGGGGSGGGGSDIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKR

SEQ ID NO: 242 - protein, 232 aa, Artificial Sequence
  Synthetic Construct
DIVITQSHKFMPTSVGDRVSITCKASQDVSTAVAWYQQKPGQSPKLLIYSASYRYTGVPDRFTGSGSGTDFTFTISSVQAEDLAVYYCQQHYSTPYTFGGGTKLEIKRGGGGSGGGGSGGGGSDIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKR

SEQ ID NO: 243 - protein, 247 aa, Artificial Sequence
  Synthetic Construct
DVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKRGGGGSGGGGSGGGGSEVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSS

SEQ ID NO: 244 - protein, 249 aa, Artificial Sequence
  Synthetic Construct
DVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKRGGGGSGGGGSGGGGSQVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVS

SEQ ID NO: 245 - protein, 245 aa, Artificial Sequence
  Synthetic Construct
DVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKRGGGGSGGGGSGGGGSEVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSS

SEQ ID NO: 246 - protein, 247 aa, Artificial Sequence
  Synthetic Construct
DVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKRGGGGSGGGGSGGGGSQVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSS

SEQ ID NO: 247 - protein, 244 aa, Artificial Sequence
  Synthetic Construct
DVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKRGGGGSGGGGSGGGGSQVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVS

SEQ ID NO: 248 - protein, 242 aa, Artificial Sequence
  Synthetic Construct
DVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKRGGGGSGGGGSGGGGSEVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSS

SEQ ID NO: 249 - protein, 245 aa, Artificial Sequence
  Synthetic Construct
DVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKRGGGGSGGGGSGGGGSQVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSS

SEQ ID NO: 250 - protein, 249 aa, Artificial Sequence
  Synthetic Construct
DVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKRGGGGSGGGGSGGGGSEVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSA

SEQ ID NO: 251 - protein, 246 aa, Artificial Sequence
  Synthetic Construct
DVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKRGGGGSGGGGSGGGGSQVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSA

SEQ ID NO: 252 - protein, 241 aa, Artificial Sequence
  Synthetic Construct
DVVMTQTPLTLSVTTGQPASISCKSSQSLLNSDGKTFLNWLLQRPGQSPKRLIYLVSKLDSGVPDRFTGSGSGTDFTLKICRVEAEDLGVYYCWQGTHFPYTFGGGTKLEIKRGGGGSGGGGSGGGGSEVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSA

SEQ ID NO: 253 - protein, 248 aa, Artificial Sequence
  Synthetic Construct
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKRGGGGSGGGGSGGGGSEVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSS

SEQ ID NO: 254 - protein, 248 aa, Artificial Sequence
  Synthetic Construct
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKRGGGGSGGGGSGGGGSQVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVT

SEQ ID NO: 255 - protein, 246 aa, Artificial Sequence
  Synthetic Construct
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKRGGGGSGGGGSGGGGSEVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSS

SEQ ID NO: 256 - protein, 248 aa, Artificial Sequence
  Synthetic Construct
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKRGGGGSGGGGSGGGGSQVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSS

SEQ ID NO: 257 - protein, 245 aa, Artificial Sequence
  Synthetic Construct
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKRGGGGSGGGGSGGGGSQVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVS

SEQ ID NO: 258 - protein, 243 aa, Artificial Sequence
  Synthetic Construct
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKRGGGGSGGGGSGGGGSEVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSS

SEQ ID NO: 259 - protein, 246 aa, Artificial Sequence
  Synthetic Construct
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKRGGGGSGGGGSGGGGSQVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSS

SEQ ID NO: 260 - protein, 250 aa, Artificial Sequence
  Synthetic Construct
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKRGGGGSGGGGSGGGGSEVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSA

SEQ ID NO: 261 - protein, 247 aa, Artificial Sequence
  Synthetic Construct
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKRGGGGSGGGGSGGGGSQVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSA

SEQ ID NO: 262 - protein, 242 aa, Artificial Sequence
  Synthetic Construct
DIVMSQSPSSLAVSVGEKVTMSCKSSQSLLYSSNQKNYLAWYQQKPGQSPKLLIYWASTRESGVPDRFTGSGSGTDFTLTISSVKAEDLAVYYCQQYYSYPRTFGGGTKLEIKRGGGGSGGGGSGGGGSEVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSA

SEQ ID NO: 263 - protein, 248 aa, Artificial Sequence
  Synthetic Construct
DIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKRGGGGSGGGGSGGGGSEVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSS

SEQ ID NO: 264 - protein, 250 aa, Artificial Sequence
  Synthetic Construct
DIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKRGGGGSGGGGSGGGGSQVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVS

SEQ ID NO: 265 - protein, 246 aa, Artificial Sequence
  Synthetic Construct
DIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKRGGGGSGGGGSGGGGSEVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSS

SEQ ID NO: 266 - protein, 248 aa, Artificial Sequence
  Synthetic Construct
DIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKRGGGGSGGGGSGGGGSQVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSS

SEQ ID NO: 267 - protein, 245 aa, Artificial Sequence
  Synthetic Construct
DIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKRGGGGSGGGGSGGGGSQVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVS

SEQ ID NO: 268 - protein, 243 aa, Artificial Sequence
  Synthetic Construct
DIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKRGGGGSGGGGSGGGGSEVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSS

SEQ ID NO: 269 - protein, 246 aa, Artificial Sequence
  Synthetic Construct
DIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKRGGGGSGGGGSGGGGSQVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSS

SEQ ID NO: 270 - protein, 250 aa, Artificial Sequence
  Synthetic Construct
DIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKRGGGGSGGGGSGGGGSEVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSA

SEQ ID NO: 271 - protein, 247 aa, Artificial Sequence
  Synthetic Construct
DIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKRGGGGSGGGGSGGGGSQVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSA

SEQ ID NO: 272 - protein, 242 aa, Artificial Sequence
  Synthetic Construct
DIVLTQSTSSLAVSVGEKVTMSCKSSQSLLFGSNQKNYLAWYQQKLGQSPKLLIFWASTRESGVPDRFTGSGSGTDFTLTISSVKAEDLAVYYCQQYYSYPFTFGSGTKLEIKRGGGGSGGGGSGGGGSEVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSA

SEQ ID NO: 273 - protein, 247 aa, Artificial Sequence
  Synthetic Construct
DIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKRGGGGSGGGGSGGGGSEVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSS

SEQ ID NO: 274 - protein, 249 aa, Artificial Sequence
  Synthetic Construct
DIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKRGGGGSGGGGSGGGGSQVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVS

SEQ ID NO: 275 - protein, 245 aa, Artificial Sequence
  Synthetic Construct
DIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKRGGGGSGGGGSGGGGSEVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSS

SEQ ID NO: 276 - protein, 247 aa, Artificial Sequence
  Synthetic Construct
DIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKRGGGGSGGGGSGGGGSQVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSS

SEQ ID NO: 277 - protein, 244 aa, Artificial Sequence
  Synthetic Construct
DIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKRGGGGSGGGGSGGGGSQVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVS

SEQ ID NO: 278 - protein, 242 aa, Artificial Sequence
  Synthetic Construct
DIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKRGGGGSGGGGSGGGGSEVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSS

SEQ ID NO: 279 - protein, 245 aa, Artificial Sequence
  Synthetic Construct
DIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKRGGGGSGGGGSGGGGSQVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSS

SEQ ID NO: 280 - protein, 249 aa, Artificial Sequence
  Synthetic Construct
DIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKRGGGGSGGGGSGGGGSEVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSA

SEQ ID NO: 281 - protein, 246 aa, Artificial Sequence
  Synthetic Construct
DIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKRGGGGSGGGGSGGGGSQVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSA

SEQ ID NO: 282 - protein, 241 aa, Artificial Sequence
  Synthetic Construct
DIVLTQTNLTLSITIGQPASISCKSSQSLLDSDGKTYLNWLLQRPGQSPKRLIYLVSKLDSGVPDRFTGSGSGTDFTLKISRVGAEDLGIYYCWQGTHFPHTFGGGTKLEIKRGGGGSGGGGSGGGGSEVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSA

SEQ ID NO: 283 - protein, 243 aa, Artificial Sequence
  Synthetic Construct
DIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKRGGGGSGGGGSGGGGSEVKLEESGGGLVKPGGSLKLSCAASGFTFSSYAMSWVRQTPEKRLEWVASISSGGSTYYPDSVKGRFTISRDNARNTLYLQMSSLRSEDTAMYYCARGRDGYSLYFDYWGQGTTLTVSS

SEQ ID NO: 284 - protein, 245 aa, Artificial Sequence
  Synthetic Construct
DIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKRGGGGSGGGGSGGGGSQVKLQESGGGLVKPGGSLKLSCAASGFTFSSYAMSWVRQTPEKRLEWVAGISSGGSFTYYPDTVKGRFTISRDNARNTLYLQMSSLRSEDTAMYSCAREGVYSDYRAWFAYWGQGTLVTVS

SEQ ID NO: 285 - protein, 241 aa, Artificial Sequence
  Synthetic Construct
DIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKRGGGGSGGGGSGGGGSEVKLEQSGPSLVQPSQSLSITCTVSGFSLTNFGVHWVRQSPGKGLEWLGLIWRGGSTDYNAAFMSRLSITKDNSKSQVFFKMNSLQADDTAIYYCAKMGITYYFDYWGQGTTLTVSS

SEQ ID NO: 286 - protein, 243 aa, Artificial Sequence
  Synthetic Construct
DIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKRGGGGSGGGGSGGGGSQVKLQQSGDDLVKPGASVKLSCKASGYTFTSYWINWIKQRPGQGLEWIGHIAPGTGSTYYSEMFKDKATLTVDTPSSSAYIQLSSLSSEDSAVYFCAREGGRYYTLDCWGQGTSVTVSS

SEQ ID NO: 287 - protein, 240 aa, Artificial Sequence
  Synthetic Construct
DIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKRGGGGSGGGGSGGGGSQVQLEESGPGLVKPSQTVSLTCTVTGISITTGNYRWSWIRQFPGNKLEWIGYIYYSGTITYNPSLTSRTTITRDTSKNQFFLEMNSLTAEDTATYYCARWLNNFDVWGTGTTVTVS

SEQ ID NO: 288 - protein, 238 aa, Artificial Sequence
  Synthetic Construct
DIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKRGGGGSGGGGSGGGGSEVMLVESGGGLVKPGGSLKLSCAASGFTFSRYAMSWNRQTPEKRLEWVATISPGGGYIYYSDSVKGRFTISRDNARNTLYLQMSSLRSEDTAMYYCAGDYVDYWGQGTTLTVSS

SEQ ID NO: 289 - protein, 241 aa, Artificial Sequence
  Synthetic Construct
DIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKRGGGGSGGGGSGGGGSQVQLQESGPGLVKPSQSLSLTCTVTGYSITSDYAWNWIRQFPGNKLEWMGYISYSGSTTYNPSLKGRISFTRDTSKNQFFLHLKSVTTEDSATYYCARNWVYAMDYWGQGTSVTVSS

SEQ ID NO: 290 - protein, 245 aa, Artificial Sequence
  Synthetic Construct
DIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKRGGGGSGGGGSGGGGSEVKLQQSGPVLVKPGASVKISCKASGYTFTDYYYMNWVKQSHGKSLEWIGYIYPNNSGTSYNQKFRGKATLTVDKSSSTAYMEVRSLTSEDSAVYYCARYYDGFNAGFAYWGQGTLVTVSA

SEQ ID NO: 291 - protein, 242 aa, Artificial Sequence
  Synthetic Construct
DIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKRGGGGSGGGGSGGGGSQVQLEESGPGLVAPSQSLSITCTVSGFSLSRYSVHWVRQPPGKGLEWLGMIWVNGNTDYNSALKSRLNINKDNSKSQVFLKMNSLQTDDTAMYYCATYYGNYDSFTYWGQGTLVTVSA

SEQ ID NO: 292 - protein, 237 aa, Artificial Sequence
  Synthetic Construct
DIVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGAGTKLELKRGGGGSGGGGSGGGGSEVQLQESGAELARPGASVKMSCKASGYTFTSYWMHWVKQRPGQGLEWIGAIYPGNSDTSYNQKFKGKAKLTAVTSASTAYMELSSLTNEDSAVYYCTTSLAYWGQGTLVTVSA

SEQ ID NO: 293 - protein, 8 aa, Artificial Sequence
  Synthetic Construct
GYTFTDYE

SEQ ID NO: 294 - protein, 8 aa, Artificial Sequence
  Synthetic Construct
GFDFSRYW

SEQ ID NO: 295 - protein, 8 aa, Artificial Sequence
  Synthetic Construct
GFNIKDTY

SEQ ID NO: 296 - protein, 8 aa, Artificial Sequence
  Synthetic Construct
GYTFTSYG

SEQ ID NO: 297 - protein, 5 aa, Artificial Sequence
  Synthetic Construct
SFAMS

SEQ ID NO: 298 - protein, 5 aa, Artificial Sequence
  Synthetic Construct
NYGMS

SEQ ID NO: 299 - protein, 8 aa, Artificial Sequence
  Synthetic Construct
IDPETGDT

SEQ ID NO: 300 - protein, 8 aa, Artificial Sequence
  Synthetic Construct
INPDSSTI

SEQ ID NO: 301 - protein, 8 aa, Artificial Sequence
  Synthetic Construct
IDPANGNV

SEQ ID NO: 302 - protein, 8 aa, Artificial Sequence
  Synthetic Construct
IYPRSGNT

SEQ ID NO: 303 - protein, 20 aa, Artificial Sequence
  Synthetic Construct
TISSGGAYTFYKDSVKGRFT

SEQ ID NO: 304 - protein, 20 aa, Artificial Sequence
  Synthetic Construct
SISSGDGRTYYSDNIRGRFT

SEQ ID NO: 305 - protein, 8 aa, Artificial Sequence
  Synthetic Construct
TRANSFGY

SEQ ID NO: 306 - protein, 11 aa, Artificial Sequence
  Synthetic Construct
ARPGYYYAMDY

SEQ ID NO: 307 - protein, 9 aa, Artificial Sequence
  Synthetic Construct
DLSHYTMDY

SEQ ID NO: 308 - protein, 5 aa, Artificial Sequence
  Synthetic Construct
ARSRV

SEQ ID NO: 309 - protein, 14 aa, Artificial Sequence
  Synthetic Construct
HSGYDGYYLYAMDY

SEQ ID NO: 310 - protein, 7 aa, Artificial Sequence
  Synthetic Construct
RGDAMDY

SEQ ID NO: 311 - protein, 9 aa, Artificial Sequence
  Synthetic Construct
TGAVTTSNY

SEQ ID NO: 312 - protein, 10 aa, Artificial Sequence
  Synthetic Construct
KSVSTSGYSY

SEQ ID NO: 313 - protein, 5 aa, Artificial Sequence
  Synthetic Construct
SSVSY

SEQ ID NO: 314 - protein, 11 aa, Artificial Sequence
  Synthetic Construct
RASQDISNYLN

SEQ ID NO: 315 - protein, 10 aa, Artificial Sequence
  Synthetic Construct
SASSSVSYMH

SEQ ID NO: 316 - protein, 4 aa, Artificial Sequence
  Synthetic Construct
  MISC_FEATURE (1)..(1): Xaa is any amino acid
XGTN

SEQ ID NO: 317 - protein, 4 aa, Artificial Sequence
  Synthetic Construct
  MISC_FEATURE (1)..(1): Xaa is any amino acid
XLVS

SEQ ID NO: 318 - protein, 4 aa, Artificial Sequence
  Synthetic Construct
  MISC_FEATURE (1)..(1): Xaa is any amino aicd
XLTS

SEQ ID NO: 319 - protein, 7 aa, Artificial Sequence
  Synthetic Construct
YTSRLHS

SEQ ID NO: 320 - protein, 7 aa, Artificial Sequence
  Synthetic Construct
EISKLAS

SEQ ID NO: 321 - protein, 9 aa, Artificial Sequence
  Synthetic Construct
ALWYNNHLV

SEQ ID NO: 322 - protein, 7 aa, Artificial Sequence
  Synthetic Construct
QHIRELT

SEQ ID NO: 323 - protein, 9 aa, Artificial Sequence
  Synthetic Construct
QQWSSNPFT

SEQ ID NO: 324 - protein, 9 aa, Artificial Sequence
  Synthetic Construct
QQGNTLPPT

SEQ ID NO: 325 - protein, 9 aa, Artificial Sequence
  Synthetic Construct
QQWNYPLIT

SEQ ID NO: 326 - protein, 116 aa, Artificial Sequence
  Synthetic Construct
EVQLQESGAELVKPGASVKLSCTASGFNIKDTYMHWVKQRPEQGLEWIGRIDPANGNVEYDPKFQGKATLTADTSSNTAYLQLSSLTSEDTAVYYCDLSHYTMDYWGQGTSVTVSS

SEQ ID NO: 327 - protein, 115 aa, Artificial Sequence
  Synthetic Construct
QVQLQQSGAELVRPGASVTLSCKASGYTFTDYEMHWVKQTPVHGLEWIGAIDPETGDTAYNQKFKGKATLTADKSSSTAYMELSSLTSEDSAVYYCTRANSFGYWGQGTTLTVSS

SEQ ID NO: 328 - protein, 111 aa, Artificial Sequence
  Synthetic Construct
VQLQQSGAELARPGASVKLSCKASGYTFTSYGISWVKQRTGQGLEWIGEIYPRSGNTYYNEKFKGKATLTADKSSSTAYMELRSLTSEDSAVYFCARSRVWGTGTTVTVSS

SEQ ID NO: 329 - protein, 123 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDYWGQGTSVTVSS

SEQ ID NO: 330 - protein, 120 aa, Artificial Sequence
  Synthetic Construct
EVKLVESGGDLVKPGASLKLSCAASGFTFSNYGMSWIRQTSDKRLEWVASISSGDGRTYYSDNIRGRFTISSENAKNTLYLQMSSLKSEDTALYYCTRGRGLRGDAMDYWGQGTSVTVSS

SEQ ID NO: 331 - protein, 118 aa, Artificial Sequence
  Synthetic Construct
EVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPGYYYAMDYWGQGTSVTVSS

SEQ ID NO: 332 - protein, 108 aa, Artificial Sequence
  Synthetic Construct
QAIVTQESALTTSPGETVTLTCRSSTGAVTTSNYATWVQEKPDHLFTGLMGGTNIRAPGVPARFSGSLIGDKAALTITGAQTEDEAIYFCALWYNNHLVFGGGTKLTV

SEQ ID NO: 333 - protein, 107 aa, Artificial Sequence
  Synthetic Construct
QIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIKR

SEQ ID NO: 334 - protein, 107 aa, Artificial Sequence
  Synthetic Construct
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPPTFGGGTKLEIK

SEQ ID NO: 335 - protein, 105 aa, Artificial Sequence
  Synthetic Construct
EIVLTQSPAITAASLGQKVTITCSASSSVSYMHWYQQKSGTSPKPWIYEISKLASGVPARFSGSGSGTSYSLTISSMEAEDAAIYYCQQWNYPLITFGGGTKLEI

SEQ ID NO: 336 - protein, 108 aa, Artificial Sequence
  Synthetic Construct
DIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWK

SEQ ID NO: 337 - DNA, 348 bp, Artificial Sequence
  Synthetic Construct
gaggtacagctgcaggagtctggggcagaacttgtgaagccaggggcctctgtcaagttgtcctgcacagcttctggcttcaacattaaagacacctatatgcactgggtgaaacagaggcctgaacagggcctggagtggattggaaggattgatcctgcgaatggtaatgttgaatatgacccgaagttccagggcaaggccactctaacagcagacacatcctccaatacagcctacctgcaactcagcagcctgacatctgaggacactgccgtctattactgtgacctatcccactatactatggactactggggtcagggaacctcagtcaccgtctcctca

SEQ ID NO: 338 - DNA, 345 bp, Artificial Sequence
  Synthetic Construct
caggttcaactgcagcagtctggagctgagctggtgaggcctggggcttcagtgacgctgtcctgcaaggcttcgggctacacatttactgactatgaaatgcactgggtgaagcagacacctgtgcatggcctggaatggattggagctattgatcctgaaactggtgatactgcctacaatcagaagttcaagggcaaggccacactgactgcagacaaatcctccagcacagcctacatggagctcagcagcctgacatctgaggactctgccgtctattactgtacaagagctaactcttttggctactggggccaaggcaccactctcacagtctcctca

SEQ ID NO: 339 - DNA, 333 bp, Artificial Sequence
  Synthetic Construct
gttcagctgcagcagtctggagctgagctggcgaggcctggggcttcagtgaagctgtcctgcaaggcttctggctacaccttcacaagctatggtataagctgggtgaagcagagaactggacagggccttgagtggattggagagatttatcctagaagtggtaatacttactacaatgagaagttcaagggcaaggccacactgactgcagacaaatcctccagcacagcgtacatggagctccgcagcctgacatctgaagactctgcggtctatttctgtgcaagatcccgagtctggggcacagggaccacggtcaccgtctcctca

SEQ ID NO: 340 - DNA, 369 bp, Artificial Sequence
  Synthetic Construct
gatgtgaagcttcaggagtctgggggaggcttagtgaagcctggagggtccctgaaactctcctgtgcagtctctggattcactttcagttcctttgccatgtcttgggttcgccagactccggagaagaggctggagtgggtcgcaaccattagtagtggtggagcttacaccttctataaagacagtgtgaaggggcgattcaccatctccagagacaatgccaagaataccctgtacctgcaaatgagcagtctgaggtctgaggactcggccatgtattactgtgcaagacatagcggctatgatggttactacctctatgctatggactactggggtcaaggaacctcagtcaccgtctcctca

SEQ ID NO: 341 - DNA, 360 bp, Artificial Sequence
  Synthetic Construct
gaagtgaagctggtggagtctgggggagacttagtgaagcctggagcgtctctgaaactctcctgtgcagcctctgggttcactttcagtaactatggcatgtcttggattcgccagacttcagacaagaggctggagtgggtcgcatccattagtagtggtgatggtagaacctactattcagacaatataaggggccgattcaccatctccagcgagaatgccaagaacaccctgtacctgcaaatgagcagtctgaagtctgaggacacggccttgtattactgtacaagaggccggggattacggggggatgctatggactactggggtcaaggaacctcagtcaccgtctcctca

SEQ ID NO: 342 - DNA, 354 bp, Artificial Sequence
  Synthetic Construct
gaggtgaagcttctcgagtctggaggtggcctggtgcagcctggaggatccctgaaactctcctgtgcagcctcaggattcgattttagtagatactggatgagttgggtccggcaggctccagggaaagggctagaatggattggagaaattaatccagatagcagtacgataaactatacgccatctctaaaggataaattcatcatctccagagacaacgccaaaaatacgctgtacctgcaaatgagcaaagtgagatctgaggacacagccctttattactgtgcaagaccgggttactactatgctatggactactggggtcaaggaacctcagtcaccgtctcctca

SEQ ID NO: 343 - DNA, 324 bp, Artificial Sequence
  Synthetic Construct
caggctattgtgactcaggaatctgcactcaccacatcacctggtgaaacagtcacactcacttgtcgctcaagcactggggctgttacaactagtaattatgccacctgggtccaagaaaaaccagatcatttattcactggtctgatgggtggcaccaacatccgagctccaggtgttcctgccagattctcaggctccctgattggagacaaggctgccctcaccatcacaggggcacagactgaggatgaggcaatatatttctgtgctctatggtacaacaaccatttggtgttcggtggaggaaccaaactgactgtc

SEQ ID NO: 344 - DNA, 321 bp, Artificial Sequence
  Synthetic Construct
caaattgttctcacccagtctccagcactcatgtctgcatctccaggggagaaggtcaccatgacctgcagtgccagctcaagtgtaagttacatgtactggtaccagcagaagccaagatcctcccccaaaccctggatttatctcacatccaacctggcttctggagtccctgctcgcttcagtggcagtgggtctgggacctcttactctctcacaatcagcagcatggaggctgaagatgctgccacttattactgccagcagtggagtagtaacccattcacgttcggctcggggacaaagttggaaataaaacgg

SEQ ID NO: 345 - DNA, 321 bp, Artificial Sequence
  Synthetic Construct
gatatccagatgacacagactacatcctccctgtctgcctctctgggagacagagtcaccatcagttgcagggcaagtcaggacattagcaattatttaaactggtatcagcagaaaccagatggaactgttaaactcctgatctactacacatcaagattacactcaggagtcccatcaaggttcagtggcagtgggtctggaacagattattctctcaccattagcaacctggagcaagaagatattgccacttacttttgccaacagggtaatacgcttcctccgacgttcggtggaggcaccaagctggaaatcaaa

SEQ ID NO: 346 - DNA, 315 bp, Artificial Sequence
  Synthetic Construct
gaaattgtgctcactcagtctccagccatcacagctgcatctctggggcaaaaggtcaccatcacctgcagtgccagctcaagtgtaagttacatgcactggtaccagcagaagtcaggcacctcccccaaaccatggatttatgaaatatccaaactggcttctggagtcccagctcgcttcagtggcagtgggtctgggacctcttactctctcacaatcagcagcatggaggctgaagatgctgccatttattactgccagcagtggaattatcctcttatcacgttcggaggggggaccaagctggaaata

SEQ ID NO: 347 - DNA, 327 bp, Artificial Sequence
  Synthetic Construct
gacattgtgctgacacagtctcctgcttccttagctgtatctctggggcagagggccaccatctcatacagggccagcaaaagtgtcagtacatctggctatagttatatgcactggaaccaacagaaaccaggacagccacccagactcctcatctatcttgtatccaacctagaatctggggtccctgccaggttcagtggcagtgggtctgggacagacttcaccctcaacatccatcctgtggaggaggaggatgctgcaacctattactgtcagcacattagggagcttacacgttcggaggggggaccaagctggaaataa

SEQ ID NO: 348 - protein, 239 aa, Artificial Sequence
  Synthetic Construct
EVQLQESGAELVKPGASVKLSCTASGFNIKDTYMHWVKQRPEQGLEWIGRIDPANGNVEYDPKFQGKATLTADTSSNTAYLQLSSLTSEDTAVYYCDLSHYTMDYWGQGTSVTVSSGGGGSGGGGSGGGGSQAIVTQESALTTSPGETVTLTCRSSTGAVTTSNYATWVQEKPDHLFTGLMGGTNIRAPGVPARFSGSLIGDKAALTITGAQTEDEAIYFCALWYNNHLVFGGGTKLTV

SEQ ID NO: 349 - protein, 238 aa, Artificial Sequence
  Synthetic Construct
EVQLQESGAELVKPGASVKLSCTASGFNIKDTYMHWVKQRPEQGLEWIGRIDPANGNVEYDPKFQGKATLTADTSSNTAYLQLSSLTSEDTAVYYCDLSHYTMDYWGQGTSVTVSSGGGGSGGGGSGGGGSQIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIKR

SEQ ID NO: 350 - protein, 238 aa, Artificial Sequence
  Synthetic Construct
EVQLQESGAELVKPGASVKLSCTASGFNIKDTYMHWVKQRPEQGLEWIGRIDPANGNVEYDPKFQGKATLTADTSSNTAYLQLSSLTSEDTAVYYCDLSHYTMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTISNLEQEDIATYFCQQGNTLPPTFGGGTKLEIK

SEQ ID NO: 351 - protein, 236 aa, Artificial Sequence
  Synthetic Construct
EVQLQESGAELVKPGASVKLSCTASGFNIKDTYMHWVKQRPEQGLEWIGRIDPANGNVEYDPKFQGKATLTADTSSNTAYLQLSSLTSEDTAVYYCDLSHYTMDYWGQGTSVTVSSGGGGSGGGGSGGGGSEIVLTQSPAITAASLGQKVTITCSASSSVSYMHWYQQKSGTSPKPWIYEISKLASGVPARFSGSGSGTSYSLTISSMEAEDAAIYYCQQWNYPLITFGGGTKLEI

SEQ ID NO: 352 - protein, 239 aa, Artificial Sequence
  Synthetic Construct
EVQLQESGAELVKPGASVKLSCTASGFNIKDTYMHWVKQRPEQGLEWIGRIDPANGNVEYDPKFQGKATLTADTSSNTAYLQLSSLTSEDTAVYYCDLSHYTMDYWGQGTSVTVSSGGGGSGGGGSGGGGSDIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWK

SEQ ID NO: 353 - protein, 238 aa, Artificial Sequence
  Synthetic Construct
QVQLQQSGAELVRPGASVTLSCKASGYTFTDYEMHWVKQTPVHGLEWIGAIDPETGDTAYNQKFKGKATLTADKSSSTAYMELSSLTSEDSAVYYCTRANSFGYWGQGTTLTVSSGGGGSGGGGSGGGGSQAIVTQESALTTSPGETVTLTCRSSTGAVTTSNYATWVQEKPDHLFTGLMGGTNIRAPGVPARFSGSLIGDKAALTITGAQTEDEAIYFCALWYNNHLVFGGGTKLTV

SEQ ID NO: 354 - protein, 237 aa, Artificial Sequence
  Synthetic Construct
QVQLQQSGAELVRPGASVTLSCKASGYTFTDYEMHWVKQTPVHGLEWIGAIDPETGDTAYNQKFKGKATLTADKSSSTAYMELSSLTSEDSAVYYCTRANSFGYWGQGTTLTVSSGGGGSGGGGSGGGGSQIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIKR

SEQ ID NO: 355 - protein, 237 aa, Artificial Sequence
  Synthetic Construct
QVQLQQSGAELVRPGASVTLSCKASGYTFTDYEMHWVKQTPVHGLEWIGAIDPETGDTAYNQKFKGKATLTADKSSSTAYMELSSLTSEDSAVYYCTRANSFGYWGQGTTLTVSSGGGGSGGGGSGGGGSDIQMTQTTSSLSASLGDRVTISCRASQDISNYLNWYQQKPDGTVKLLIYYTSRLHSGVPSRFSGSGSGTDYSLTISNLEQEDIATYFCQQGNTLPPTFGGGTKLEIK

SEQ ID NO: 356 - protein, 235 aa, Artificial Sequence
  Synthetic Construct
QVQLQQSGAELVRPGASVTLSCKASGYTFTDYEMHWVKQTPVHGLEWIGAIDPETGDTAYNQKFKGKATLTADKSSSTAYMELSSLTSEDSAVYYCTRANSFGYWGQGTTLTVSSGGGGSGGGGSGGGGSEIVLTQSPAITAASLGQKVTITCSASSSVSYMHWYQQKSGTSPKPWIYEISKLASGVPARFSGSGSGTSYSLTISSMEAEDAAIYYCQQWNYPLITFGGGTKLEI

SEQ ID NO: 357 - protein, 238 aa, Artificial Sequence
  Synthetic Construct
QVQLQQSGAELVRPGASVTLSCKASGYTFTDYEMHWVKQTPVHGLEWIGAIDPETGDTAYNQKFKGKATLTADKSSSTAYMELSSLTSEDSAVYYCTRANSFGYWGQGTTLTVSSGGGGSGGGGSGGGGSDIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWK

SEQ ID NO: 358 - protein, 234 aa, Artificial Sequence
  Synthetic Construct
VQLQQSGAELARPGASVKLSCKASGYTFTSYGISWVKQRTGQGLEWIGEIYPRSGNTYYNEKFKGKATLTADKSSSTAYMELRSLTSEDSAVYFCARSRVWGTGTTVTVSSGGGGSGGGGSGGGGSQAIVTQESALTTSPGETVTLTCRSSTGAVTTSNYATWVQEKPDHLFTGLMGGTNIRAPGVPARFSGSLIGDKAALTITGAQTEDEAIYFCALWYNNHLVFGGGTKLTV

SEQ ID NO: 359 - protein, 233 aa, Artificial Sequence
  Synthetic Construct
VQLQQSGAELARPGASVKLSCKASGYTFTSYGISWVKQRTGQGLEWIGEIYPRSGNTYYNEKFKGKATLTADKSSSTAYMELRSLTSEDSAVYFCARSRVWGTGTTVTVSSGGGGSGGGGSGGGGSQIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIKR

SEQ ID NO: 360 - protein, 233 aa, Artificial Sequence
  Synthetic Construct
VQLQQSGAELARPGASVKLSCKASGYTFTSYGISWVKQRTGQGLEWIGEIYPRSGNTYYNEKFKGKATLTADKSSSTAYMELRSLTSEDSAVYFCARSRVWGTGTTVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTISNLEQEDIATYFCQQGNTLPPTFGGGTKLEIK

SEQ ID NO: 361 - protein, 231 aa, Artificial Sequence
  Synthetic Construct
VQLQQSGAELARPGASVKLSCKASGYTFTSYGISWVKQRTGQGLEWIGEIYPRSGNTYYNEKFKGKATLTADKSSSTAYMELRSLTSEDSAVYFCARSRVWGTGTTVTVSSGGGGSGGGGSGGGGSEIVLTQSPAITAASLGQKVTITCSASSSVSYMHWYQQKSGTSPKPWIYEISKLASGVPARFSGSGSGTSYSLTISSMEAEDAAIYYCQQWNYPLITFGGGTKLEI

SEQ ID NO: 362 - protein, 234 aa, Artificial Sequence
  Synthetic Construct
VQLQQSGAELARPGASVKLSCKASGYTFTSYGISWVKQRTGQGLEWIGEIYPRSGNTYYNEKFKGKATLTADKSSSTAYMELRSLTSEDSAVYFCARSRVWGTGTTVTVSSGGGGSGGGGSGGGGSDIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWK

SEQ ID NO: 363 - protein, 246 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDYWGQGTSVTVSSGGGGSGGGGSGGGGSQAIVTQESALTTSPGETVTLTCRSSTGAVTTSNYATWVQEKPDHLFTGLMGGTNIRAPGVPARFSGSLIGDKAALTITGAQTEDEAIYFCALWYNNHLVFGGGTKLTV

SEQ ID NO: 364 - protein, 245 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDYWGQGTSVTVSSGGGGSGGGGSGGGGSQIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIKR

SEQ ID NO: 365 - protein, 245 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTISNLEQEDIATYFCQQGNTLPPTFGGGTKLEIK

SEQ ID NO: 366 - protein, 243 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDYWGQGTSVTVSSGGGGSGGGGSGGGGSEIVLTQSPAITAASLGQKVTITCSASSSVSYMHWYQQKSGTSPKPWIYEISKLASGVPARFSGSGSGTSYSLTISSMEAEDAAIYYCQQWNYPLITFGGGTKLEI

SEQ ID NO: 367 - protein, 246 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDYWGQGTSVTVSSGGGGSGGGGSGGGGSDIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWK

SEQ ID NO: 368 - protein, 243 aa, Artificial Sequence
  Synthetic Construct
EVKLVESGGDLVKPGASLKLSCAASGFTFSNYGMSWIRQTSDKRLEWVASISSGDGRTYYSDNIRGRFTISSENAKNTLYLQMSSLKSEDTALYYCTRGRGLRGDAMDYWGQGTSVTVSSGGGGSGGGGSGGGGSQAIVTQESALTTSPGETVTLTCRSSTGAVTTSNYATWVQEKPDHLFTGLMGGTNIRAPGVPARFSGSLIGDKAALTITGAQTEDEAIYFCALWYNNHLVFGGGTKLTV

SEQ ID NO: 369 - protein, 242 aa, Artificial Sequence
  Synthetic Construct
EVKLVESGGDLVKPGASLKLSCAASGFTFSNYGMSWIRQTSDKRLEWVASISSGDGRTYYSDNIRGRFTISSENAKNTLYLQMSSLKSEDTALYYCTRGRGLRGDAMDYWGQGTSVTVSSGGGGSGGGGSGGGGSQIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIKR

SEQ ID NO: 370 - protein, 242 aa, Artificial Sequence
  Synthetic Construct
EVKLVESGGDLVKPGASLKLSCAASGFTFSNYGMSWIRQTSDKRLEWVASISSGDGRTYYSDNIRGRFTISSENAKNTLYLQMSSLKSEDTALYYCTRGRGLRGDAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTISNLEQEDIATYFCQQGNTLPPTFGGGTKLEIK

SEQ ID NO: 371 - protein, 240 aa, Artificial Sequence
  Synthetic Construct
EVKLVESGGDLVKPGASLKLSCAASGFTFSNYGMSWIRQTSDKRLEWVASISSGDGRTYYSDNIRGRFTISSENAKNTLYLQMSSLKSEDTALYYCTRGRGLRGDAMDYWGQGTSVTVSSGGGGSGGGGSGGGGSEIVLTQSPAITAASLGQKVTITCSASSSVSYMHWYQQKSGTSPKPWIYEISKLASGVPARFSGSGSGTSYSLTISSMEAEDAAIYYCQQWNYPLITFGGGTKLEI

SEQ ID NO: 372 - protein, 243 aa, Artificial Sequence
  Synthetic Construct
EVKLVESGGDLVKPGASLKLSCAASGFTFSNYGMSWIRQTSDKRLEWVASISSGDGRTYYSDNIRGRFTISSENAKNTLYLQMSSLKSEDTALYYCTRGRGLRGDAMDYWGQGTSVTVSSGGGGSGGGGSGGGGSDIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWK

SEQ ID NO: 373 - protein, 241 aa, Artificial Sequence
  Synthetic Construct
EVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPGYYYAMDYWGQGTSVTVSSGGGGSGGGGSGGGGSQAIVTQESALTTSPGETVTLTCRSSTGAVTTSNYATWVQEKPDHLFTGLMGGTNIRAPGVPARFSGSLIGDKAALTITGAQTEDEAIYFCALWYNNHLVFGGGTKLTV

SEQ ID NO: 374 - protein, 240 aa, Artificial Sequence
  Synthetic Construct
EVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPGYYYAMDYWGQGTSVTVSSGGGGSGGGGSGGGGSQIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIKR

SEQ ID NO: 375 - protein, 240 aa, Artificial Sequence
  Synthetic Construct
EVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPGYYYAMDYWGQGTSVTVSSGGGGSGGGGSGGGGSDIQMTQTTSSLSASLGDRVTISCRASQDISNYLNWYQQKPDGTVKLLIYYTSRLHSGVPSRFSGSGSGTDYSLTISNLEQEDIATYFCQQGNTLPPTFGGGTKLEIK

SEQ ID NO: 376 - protein, 238 aa, Artificial Sequence
  Synthetic Construct
EVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPGYYYAMDYWGQGTSVTVSSGGGGSGGGGSGGGGSEIVLTQSPAITAASLGQKVTITCSASSSVSYMHWYQQKSGTSPKPWIYEISKLASGVPARFSGSGSGTSYSLTISSMEAEDAAIYYCQQWNYPLITFGGGTKLEI

SEQ ID NO: 377 - protein, 241 aa, Artificial Sequence
  Synthetic Construct
EVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPGYYYAMDYWGQGTSVTVSSGGGGSGGGGSGGGGSDIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWK

SEQ ID NO: 378 - protein, 239 aa, Artificial Sequence
  Synthetic Construct
QAIVTQESALTTSPGETVTLTCRSSTGAVTTSNYATWVQEKPDHLFTGLMGGTNIRAPGVPARFSGSLIGDKAALTITGAQTEDEAIYFCALWYNNHLVFGGGTKLTVGGGGSGGGGSGGGGSEVQLQESGAELVKPGASVKLSCTASGFNIKDTYMHWVKQRPEQGLEWIGRIDPANGNVEYDPKFQGKATLTADTSSNTAYLQLSSLTSEDTAVYYCDLSHYTMDYWGQGTSVTVSS

SEQ ID NO: 379 - protein, 238 aa, Artificial Sequence
  Synthetic Construct
QAIVTQESALTTSPGETVTLTCRSSTGAVTTSNYATWVQEKPDHLFTGLMGGTNIRAPGVPARFSGSLIGDKAALTITGAQTEDEAIYFCALWYNNHLVFGGGTKLTVGGGGSGGGGSGGGGSQVQLQQSGAELVRPGASVTLSCKASGYTFTDYEMHWVKQTPVHGLEWIGAIDPETGDTAYNQKFKGKATLTADKSSSTAYMELSSLTSEDSAVYYCTRANSFGYWGQGTTLTVSS

SEQ ID NO: 380 - protein, 234 aa, Artificial Sequence
  Synthetic Construct
QAIVTQESALTTSPGETVTLTCRSSTGAVTTSNYATWVQEKPDHLFTGLMGGTNIRAPGVPARFSGSLIGDKAALTITGAQTEDEAIYFCALWYNNHLVFGGGTKLTVGGGGSGGGGSGGGGSVQLQQSGAELARPGASVKLSCKASGYTFTSYGISWVKQRTGQGLEWIGEIYPRSGNTYYNEKFKGKATLTADKSSSTAYMELRSLTSEDSAVYFCARSRVWGTGTTVTVSS

SEQ ID NO: 381 - protein, 246 aa, Artificial Sequence
  Synthetic Construct
QAIVTQESALTTSPGETVTLTCRSSTGAVTTSNYATWVQEKPDHLFTGLMGGTNIRAPGVPARFSGSLIGDKAALTITGAQTEDEAIYFCALWYNNHLVFGGGTKLTVGGGGSGGGGSGGGGSDVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDYWGQGTSVTVSS

SEQ ID NO: 382 - protein, 243 aa, Artificial Sequence
  Synthetic Construct
QAIVTQESALTTSPGETVTLTCRSSTGAVTTSNYATWVQEKPDHLFTGLMGGTNIRAPGVPARFSGSLIGDKAALTITGAQTEDEAIYFCALWYNNHLVFGGGTKLTVGGGGSGGGGSGGGGSEVKLVESGGDLVKPGASLKLSCAASGFTFSNYGMSWIRQTSDKRLEWVASISSGDGRTYYSDNIRGRFTISSENAKNTLYLQMSSLKSEDTALYYCTRGRGLRGDAMDYWGQGTSVTVSS

SEQ ID NO: 383 - protein, 241 aa, Artificial Sequence
  Synthetic Construct
QAIVTQESALTTSPGETVTLTCRSSTGAVTTSNYATWVQEKPDHLFTGLMGGTNIRAPGVPARFSGSLIGDKAALTITGAQTEDEAIYFCALWYNNHLVFGGGTKLTVGGGGSGGGGSGGGGSEVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPGYYYAMDYWGQGTSVTVSS

SEQ ID NO: 384 - protein, 238 aa, Artificial Sequence
  Synthetic Construct
QIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIKRGGGGSGGGGSGGGGSEVQLQESGAELVKPGASVKLSCTASGFNIKDTYMHWVKQRPEQGLEWIGRIDPANGNVEYDPKFQGKATLTADTSSNTAYLQLSSLTSEDTAVYYCDLSHYTMDYWGQGTSVTVSS

SEQ ID NO: 385 - protein, 237 aa, Artificial Sequence
  Synthetic Construct
QIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIKRGGGGSGGGGSGGGGSQVQLQQSGAELVRPGASVTLSCKASGYTFTDYEMHWVKQTPVHGLEWIGAIDPETGDTAYNQKFKGKATLTADKSSSTAYMELSSLTSEDSAVYYCTRANSFGYWGQGTTLTVSS

SEQ ID NO: 386 - protein, 233 aa, Artificial Sequence
  Synthetic Construct
QIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIKRGGGGSGGGGSGGGGSVQLQQSGAELARPGASVKLSCKASGYTFTSYGISWVKQRTGQGLEWIGEIYPRSGNTYYNEKFKGKATLTADKSSSTAYMELRSLTSEDSAVYFCARSRVWGTGTTVTVSS

SEQ ID NO: 387 - protein, 245 aa, Artificial Sequence
  Synthetic Construct
QIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIKRGGGGSGGGGSGGGGSDVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDYWGQGTSVTVSS

SEQ ID NO: 388 - protein, 242 aa, Artificial Sequence
  Synthetic Construct
QIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIKRGGGGSGGGGSGGGGSEVKLVESGGDLVKPGASLKLSCAASGFTFSNYGMSWIRQTSDKRLEWVASISSGDGRTYYSDNIRGRFTISSENAKNTLYLQMSSLKSEDTALYYCTRGRGLRGDAMDYWGQGTSVTVSS

SEQ ID NO: 389 - protein, 240 aa, Artificial Sequence
  Synthetic Construct
QIVLTQSPALMSASPGEKVTMTCSASSSVSYMYWYQQKPRSSPKPWIYLTSNLASGVPARFSGSGSGTSYSLTISSMEAEDAATYYCQQWSSNPFTFGSGTKLEIKRGGGGSGGGGSGGGGSEVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPGYYYAMDYWGQGTSVTVSS

SEQ ID NO: 390 - protein, 238 aa, Artificial Sequence
  Synthetic Construct
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPPTFGGGTKLEIKGGGGSGGGGSGGGGSEVQLQESGAELVKPGASVKLSCTASGFNIKDTYMHWVKQRPEQGLEWIGRIDPANGNVEYDPKFQGKATLTADTSSNTAYLQLSSLTSEDTAVYYCDLSHYTMDYWGQGTSVTVSS

SEQ ID NO: 391 - protein, 237 aa, Artificial Sequence
  Synthetic Construct
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPPTFGGGTKLEIKGGGGSGGGGSGGGGSQVQLQQSGAELVRPGASVTLSCKASGYTFTDYEMHWVKQTPVHGLEWIGAIDPETGDTAYNQKFKGKATLTADKSSSTAYMELSSLTSEDSAVYYCTRANSFGYWGQGTTLTVSS

SEQ ID NO: 392 - protein, 233 aa, Artificial Sequence
  Synthetic Construct
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPPTFGGGTKLEIKGGGGSGGGGSGGGGSVQLQQSGAELARPGASVKLSCKASGYTFTSYGISWVKQRTGQGLEWIGEIYPRSGNTYYNEKFKGKATLTADKSSSTAYMELRSLTSEDSAVYFCARSRVWGTGTTVTVSS

SEQ ID NO: 393 - protein, 245 aa, Artificial Sequence
  Synthetic Construct
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPPTFGGGTKLEIKGGGGSGGGGSGGGGSDVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDYWGQGTSVTVSS

SEQ ID NO: 394 - protein, 242 aa, Artificial Sequence
  Synthetic Construct
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPPTFGGGTKLEIKGGGGSGGGGSGGGGSEVKLVESGGDLVKPGASLKLSCAASGFTFSNYGMSWIRQTSDKRLEWVASISSGDGRTYYSDNIRGRFTISSENAKNTLYLQMSSLKSEDTALYYCTRGRGLRGDAMDYWGQGTSVTVSS

SEQ ID NO: 395 - protein, 240 aa, Artificial Sequence
  Synthetic Construct
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPPTFGGGTKLEIKGGGGSGGGGSGGGGSEVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPGYYYAMDYWGQGTSVTVSS

SEQ ID NO: 396 - protein, 236 aa, Artificial Sequence
  Synthetic Construct
EIVLTQSPAITAASLGQKVTITCSASSSVSYMHWYQQKSGTSPKPWIYEISKLASGVPARFSGSGSGTSYSLTISSMEAEDAAIYYCQQWNYPLITFGGGTKLEIGGGGSGGGGSGGGGSEVQLQESGAELVKPGASVKLSCTASGFNIKDTYMHWVKQRPEQGLEWIGRIDPANGNVEYDPKFQGKATLTADTSSNTAYLQLSSLTSEDTAVYYCDLSHYTMDYWGQGTSVTVSS

SEQ ID NO: 397 - protein, 235 aa, Artificial Sequence
  Synthetic Construct
EIVLTQSPAITAASLGQKVTITCSASSSVSYMHWYQQKSGTSPKPWIYEISKLASGVPARFSGSGSGTSYSLTISSMEAEDAAIYYCQQWNYPLITFGGGTKLEIGGGGSGGGGSGGGGSQVQLQQSGAELVRPGASVTLSCKASGYTFTDYEMHWVKQTPVHGLEWIGAIDPETGDTAYNQKFKGKATLTADKSSSTAYMELSSLTSEDSAVYYCTRANSFGYWGQGTTLTVSS

SEQ ID NO: 398 - protein, 231 aa, Artificial Sequence
  Synthetic Construct
EIVLTQSPAITAASLGQKVTITCSASSSVSYMHWYQQKSGTSPKPWIYEISKLASGVPARFSGSGSGTSYSLTISSMEAEDAAIYYCQQWNYPLITFGGGTKLEIGGGGSGGGGSGGGGSVQLQQSGAELARPGASVKLSCKASGYTFTSYGISWVKQRTGQGLEWIGEIYPRSGNTYYNEKFKGKATLTADKSSSTAYMELRSLTSEDSAVYFCARSRVWGTGTTVTVSS

SEQ ID NO: 399 - protein, 243 aa, Artificial Sequence
  Synthetic Construct
EIVLTQSPAITAASLGQKVTITCSASSSVSYMHWYQQKSGTSPKPWIYEISKLASGVPARFSGSGSGTSYSLTISSMEAEDAAIYYCQQWNYPLITFGGGTKLEIGGGGSGGGGSGGGGSDVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDYWGQGTSVTVSS

SEQ ID NO: 400 - protein, 240 aa, Artificial Sequence
  Synthetic Construct
EIVLTQSPAITAASLGQKVTITCSASSSVSYMHWYQQKSGTSPKPWIYEISKLASGVPARFSGSGSGTSYSLTISSMEAEDAAIYYCQQWNYPLITFGGGTKLEIGGGGSGGGGSGGGGSEVKLVESGGDLVKPGASLKLSCAASGFTFSNYGMSWIRQTSDKRLEWVASISSGDGRTYYSDNIRGRFTISSENAKNTLYLQMSSLKSEDTALYYCTRGRGLRGDAMDYWGQGTSVTVSS

SEQ ID NO: 401 - protein, 238 aa, Artificial Sequence
  Synthetic Construct
EIVLTQSPAITAASLGQKVTITCSASSSVSYMHWYQQKSGTSPKPWIYEISKLASGVPARFSGSGSGTSYSLTISSMEAEDAAIYYCQQWNYPLITFGGGTKLEIGGGGSGGGGSGGGGSEVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPGYYYAMDYWGQGTSVTVSS

SEQ ID NO: 402 - protein, 239 aa, Artificial Sequence
  Synthetic Construct
DIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVQLQESGAELVKPGASVKLSCTASGFNIKDTYMHWVKQRPEQGLEWIGRIDPANGNVEYDPKFQGKATLTADTSSNTAYLQLSSLTSEDTAVYYCDLSHYTMDYWGQGTSVTVSS

SEQ ID NO: 403 - protein, 238 aa, Artificial Sequence
  Synthetic Construct
DIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSQVQLQQSGAELVRPGASVTLSCKASGYTFTDYEMHWVKQTPVHGLEWIGAIDPETGDTAYNQKFKGKATLTADKSSSTAYMELSSLTSEDSAVYYCTRANSFGYWGQGTTLTVSS

SEQ ID NO: 404 - protein, 234 aa, Artificial Sequence
  Synthetic Construct
DIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSVQLQQSGAELARPGASVKLSCKASGYTFTSYGISWVKQRTGQGLEWIGEIYPRSGNTYYNEKFKGKATLTADKSSSTAYMELRSLTSEDSAVYFCARSRVWGTGTTVTVSS

SEQ ID NO: 405 - protein, 246 aa, Artificial Sequence
  Synthetic Construct
DIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSDVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDYWGQGTSVTVSS

SEQ ID NO: 406 - protein, 243 aa, Artificial Sequence
  Synthetic Construct
DIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLVESGGDLVKPGASLKLSCAASGFTFSNYGMSWIRQTSDKRLEWVASISSGDGRTYYSDNIRGRFTISSENAKNTLYLQMSSLKSEDTALYYCTRGRGLRGDAMDYWGQGTSVTVSS

SEQ ID NO: 407 - protein, 241 aa, Artificial Sequence
  Synthetic Construct
DIVLTQSPASLAVSLGQRATISYRASKSVSTSGYSYMHWNQQKPGQPPRLLIYLVSNLESGVPARFSGSGSGTDFTLNIHPVEEEDAATYYCQHIRELTRSEGGPSWKGGGGSGGGGSGGGGSEVKLLESGGGLVQPGGSLKLSCAASGFDFSRYWMSWVRQAPGKGLEWIGEINPDSSTINYTPSLKDKFIISRDNAKNTLYLQMSKVRSEDTALYYCARPGYYYAMDYWGQGTSVTVSS

SEQ ID NO: 408 - protein, 8 aa, Artificial Sequence
  Synthetic Construct
GYTFTSYW

SEQ ID NO: 409 - protein, 8 aa, Artificial Sequence
  Synthetic Construct
GFTFSSFG

SEQ ID NO: 410 - protein, 8 aa, Artificial Sequence
  Synthetic Construct
GFEFSRYW

SEQ ID NO: 411 - protein, 8 aa, Artificial Sequence
  Synthetic Construct
GFSLTGYG

SEQ ID NO: 412 - protein, 8 aa, Artificial Sequence
  Synthetic Construct
GFTFSNYG

SEQ ID NO: 413 - protein, 8 aa, Artificial Sequence
  Synthetic Construct
GYAFSSSW

SEQ ID NO: 414 - protein, 6 aa, Artificial Sequence
  Synthetic Construct
SFAMSW

SEQ ID NO: 415 - protein, 8 aa, Artificial Sequence
  Synthetic Construct
INPNSGST

SEQ ID NO: 416 - protein, 8 aa, Artificial Sequence
  Synthetic Construct
ISSGSSTL

SEQ ID NO: 417 - protein, 8 aa, Artificial Sequence
  Synthetic Construct
VNPDSSTI

SEQ ID NO: 418 - protein, 7 aa, Artificial Sequence
  Synthetic Construct
IWGDGST

SEQ ID NO: 419 - protein, 8 aa, Artificial Sequence
  Synthetic Construct
IYPGNSDT

SEQ ID NO: 420 - protein, 8 aa, Artificial Sequence
  Synthetic Construct
ISSGGGRI

SEQ ID NO: 421 - protein, 8 aa, Artificial Sequence
  Synthetic Construct
IYPGDGDT

SEQ ID NO: 422 - protein, 20 aa, Artificial Sequence
  Synthetic Construct
TISSGGAYTFYKDSVKGRFT

SEQ ID NO: 423 - protein, 5 aa, Artificial Sequence
  Synthetic Construct
TRPGV

SEQ ID NO: 424 - protein, 11 aa, Artificial Sequence
  Synthetic Construct
GRDSNYGYFDV

SEQ ID NO: 425 - protein, 9 aa, Artificial Sequence
  Synthetic Construct
ARGGYDFDY

SEQ ID NO: 426 - protein, 12 aa, Artificial Sequence
  Synthetic Construct
TRSHYVEGYFDV

SEQ ID NO: 427 - protein, 9 aa, Artificial Sequence
  Synthetic Construct
SQSTHVSYT

SEQ ID NO: 428 - protein, 22 aa, Artificial Sequence
  Synthetic Construct
ANSNYPSSQSSRTYSRRDWFAY

SEQ ID NO: 429 - protein, 14 aa, Artificial Sequence
  Synthetic Construct
HSGYDGYYLYAMDC

SEQ ID NO: 430 - protein, 11 aa, Artificial Sequence
  Synthetic Construct
QSIVHSNGNTY

SEQ ID NO: 431 - protein, 6 aa, Artificial Sequence
  Synthetic Construct
ENIYGA

SEQ ID NO: 432 - protein, 10 aa, Artificial Sequence
  Synthetic Construct
QSVDYDGDSY

SEQ ID NO: 433 - protein, 5 aa, Artificial Sequence
  Synthetic Construct
SSVSY

SEQ ID NO: 434 - protein, 6 aa, Artificial Sequence
  Synthetic Construct
KSISKY

SEQ ID NO: 435 - protein, 11 aa, Artificial Sequence
  Synthetic Construct
QSLVHSNGNTY

SEQ ID NO: 436 - protein, 5 aa, Artificial Sequence
  Synthetic Construct
SSVSD

SEQ ID NO: 437 - protein, 15 aa, Artificial Sequence
  Synthetic Construct
RASESVDSYGNSFMH

SEQ ID NO: 438 - protein, 4 aa, Artificial Sequence
  Synthetic Construct
  MISC_FEATURE (1)..(1): Xaa is any amino acid
XKVS

SEQ ID NO: 439 - protein, 4 aa, Artificial Sequence
  Synthetic Construct
  MISC_FEATURE (1)..(1): Xaa is any amino acid
XGAT

SEQ ID NO: 440 - protein, 4 aa, Artificial Sequence
  Synthetic Construct
  MISC_FEATURE (1)..(1): Xaa is any amino acid
XAAS

SEQ ID NO: 441 - protein, 4 aa, Artificial Sequence
  Synthetic Construct
  MISC_FEATURE (1)..(1): Xaa is any amino acid
XRTS

SEQ ID NO: 442 - protein, 4 aa, Artificial Sequence
  Synthetic Construct
  MISC_FEATURE (1)..(1): Xaa is any amino acid
XSGS

SEQ ID NO: 443 - protein, 4 aa, Artificial Sequence
  Synthetic Construct
  MISC_FEATURE (1)..(1): Xaa is any amino acid
XKVS

SEQ ID NO: 444 - protein, 4 aa, Artificial Sequence
  Synthetic Construct
  MISC_FEATURE (1)..(1): Xaa is any amino acid
XDTS

SEQ ID NO: 445 - protein, 7 aa, Artificial Sequence
  Synthetic Construct
LASNLES

SEQ ID NO: 446 - protein, 9 aa, Artificial Sequence
  Synthetic Construct
FQGSHVPPT

SEQ ID NO: 447 - protein, 9 aa, Artificial Sequence
  Synthetic Construct
QNVLSTPWT

SEQ ID NO: 448 - protein, 9 aa, Artificial Sequence
  Synthetic Construct
QQSNEDPFT

SEQ ID NO: 449 - protein, 9 aa, Artificial Sequence
  Synthetic Construct
QQYHSYPYT

SEQ ID NO: 450 - protein, 9 aa, Artificial Sequence
  Synthetic Construct
QQHNEYPWT

SEQ ID NO: 451 - protein, 9 aa, Artificial Sequence
  Synthetic Construct
SQSTHVSYT

SEQ ID NO: 452 - protein, 9 aa, Artificial Sequence
  Synthetic Construct
QQWSSNPLT

SEQ ID NO: 453 - protein, 7 aa, Artificial Sequence
  Synthetic Construct
NNEDPWT

SEQ ID NO: 454 - protein, 112 aa, Artificial Sequence
  Synthetic Construct
QVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSS

SEQ ID NO: 455 - protein, 112 aa, Artificial Sequence
  Synthetic Construct
EVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICL

SEQ ID NO: 456 - protein, 117 aa, Artificial Sequence
  Synthetic Construct
VKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSS

SEQ ID NO: 457 - protein, 114 aa, Artificial Sequence
  Synthetic Construct
VQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSS

SEQ ID NO: 458 - protein, 118 aa, Artificial Sequence
  Synthetic Construct
VQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSS

SEQ ID NO: 459 - protein, 129 aa, Artificial Sequence
  Synthetic Construct
QVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSA

SEQ ID NO: 460 - protein, 123 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSS

SEQ ID NO: 461 - protein, 122 aa, Artificial Sequence
  Synthetic Construct
EVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSS

SEQ ID NO: 462 - protein, 113 aa, Artificial Sequence
  Synthetic Construct
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKR

SEQ ID NO: 463 - protein, 108 aa, Artificial Sequence
  Synthetic Construct
DIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKR

SEQ ID NO: 464 - protein, 112 aa, Artificial Sequence
  Synthetic Construct
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKR

SEQ ID NO: 465 - protein, 107 aa, Artificial Sequence
  Synthetic Construct
DIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKR

SEQ ID NO: 466 - protein, 108 aa, Artificial Sequence
  Synthetic Construct
DVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKR

SEQ ID NO: 467 - protein, 107 aa, Artificial Sequence
  Synthetic Construct
QIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKR

SEQ ID NO: 468 - protein, 111 aa, Artificial Sequence
  Synthetic Construct
NIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIK

SEQ ID NO: 469 - protein, 113 aa, Artificial Sequence
  Synthetic Construct
DVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKR

SEQ ID NO: 470 - DNA, 336 bp, Artificial Sequence
  Synthetic Construct
caagttaagctgcagcagtctggggctgaactgggcaagcctgggacatcagtgaagctgtcctgcaaggcttctggctacaccttcaccagctattggatgcactgggtgaagcagaggcctggacaaggccttgagtggattggaaatattaatcctaatagtggtagtactaactacaatgagaagttcaagagcaaggccacactgactgtagacaaatcctccagcacagcctacatgcagctcagcaccctgacatctgaggactctgcggtctactactgtacaagaccgggggtctggggcacagggaccacggtcaccgtctcctca

SEQ ID NO: 471 - DNA, 336 bp, Artificial Sequence
  Synthetic Construct
gaggtgaagctgcagcagtctgggggaggcttagtgcagcctggagggtcccggaaactctcctgtgcagcctctggattcactttcagtagctttggaatgcactgggttcgtcaggctccagagaaggggctggagtgggtcgcatacattagtagtggcagtagtaccctccactatgcagacacagtgaagggccgattcaccatctccagagacaatcccaagaacaccctgttcctgcaaatgaaactaccctcactatgctatggactactggggtcaaggaacctcagtcaccgtctcctcagccaaaacgacacccccatctgccta

SEQ ID NO: 472 - DNA, 351 bp, Artificial Sequence
  Synthetic Construct
gtgaagcttctcgagtctggaggtggcctggtgcagcctggaggatccctgaaactctcctgtgcagcctcaggattcgaatttagtagatactggatgagttgggtccggcaggttccagggaaagggctagaatggattggagaagttaatccagatagcagtacgataaactatacgacatctctaaaggataaattcatcatctccagagacaacgccaaaaatacgctgtacctgcaaatgagcaaagtgagatctgaggacacagccctttattactgtggaagagatagtaattacgggtacttcgatgtctggggcacagggaccacggtcaccgtctcctca

SEQ ID NO: 473 - DNA, 342 bp, Artificial Sequence
  Synthetic Construct
gtgcagctgaaggagtcaggacctggcctggtggcgccctcacagagcctgtccatcacatgcaccgtctcagggttctcattaaccggctatggtgtaaactgggttcgccagcctccaggaaagggtctggagtggctgggaatgatatggggtgatggaagcacagactataattcagctctcaaatccagactgagcatcagcaaggacaactccaagagccaagttttcttaaaaatgaacagtctgcaaactgatgacacagccaggtactactgtgccagaggaggctacgactttgactactggggccaaggcaccactctcacagtctcctca

SEQ ID NO: 474 - DNA, 354 bp, Artificial Sequence
  Synthetic Construct
gttcagctccagcagtctggggctgagctggcaagacctggggcttcagtgaagatgtcctgcaaggcttctggctacacctttaccagctactggatgcactgggtaaaacagaggcctggacagggtctggaatggattggcgctatttatcctggaaatagtgatactagctacaatcagaagttcaagggcaaggccaaactgactgcagtcacatccgccagcactgcctacatggagctcagcagcctaacaaatgaggactctgcggtctattactgtacaagaagccactacgtagagggatacttcgatgtctggggcacagggaccacggtcaccgtctcctca

SEQ ID NO: 475 - DNA, 387 bp, Artificial Sequence
  Synthetic Construct
caagttaagctgcagcagtctggggctgagctggtgaagcctggggcctcagtgaagatttcctgcaaagcttctggctacgcattcagtagctcctggatgaactgggtgaagcagaggcctggaaagggtcttgagtggattggacagatttatcctggagatggtgatactaagtacaatggaaagttcaagggcaaagccacactgactgcagacaaatcctccagcacagcctacatgcaactcagcagcctgacatctgaggactctgcggtctatttctgtgcaaatagtaactaccccagtagtcaaagtagtcgtacctatagtagaagggactggtttgcttactggggccaagggactctggtcactgtctctgca

SEQ ID NO: 476 - DNA, 369 bp, Artificial Sequence
  Synthetic Construct
gatgtgaagcttcaggagtctgggggaggcttagtgaagcctggagggtccctgaaactctcctgtgcagtctctggattcactttcagttcctttgccatgtcttgggttcgccagactccggagaagaggctggagtgggtcgcaaccattagtagtggtggagcttacaccttctataaagacagtgtgaaggggcgattcaccatctccagagacaatgccaagaataccctgtacctgcaaatgagcagtctgaggtctgaggactcggccatgtattactgtgcaagacatagcggctatgatggttactacctctatgctatggactgctggggtcaaggaacctcagtcaccgtctcctca

SEQ ID NO: 477 - DNA, 366 bp, Artificial Sequence
  Synthetic Construct
gaggtcaagctgcagcagtctgggggaggcttagtgaagcctggagcgtctctgaaactctcctgtgcagcctctggattcactttcagtaactatggcatgtcttgggttcgccagacttcagacaagaggctggagtgggtcgcatccattagtagtggtggtggtaggatatactatccagacaatgtaaagggccgattcaccatctccagagaaaatgccaagaacaccctgtacctgcaaatgaatagtctgaagtctgacgacacggccttgtattactgtgcaagagagccccctaattactatggtggtacctacggagactactggggccaaggcaccactctcacagtctcctca

SEQ ID NO: 478 - DNA, 339 bp, Artificial Sequence
  Synthetic Construct
gatgttttgatgacccaaactccactctccctgcctgtcagtcttggagatcaagcctccatctcttgcagatctagtcagagcattgtacatagtaatggaaacacctatttagaatggtacctgcagaaaccaggccagtctccaaagctcctgatctacaaagtttccaaccgattttctggggtcccagacaggttcagtggcagtggatcagggacagatttcacactcaagatcagcagagtggaggctgaggatctgggagtttattactgctttcaaggttcacatgttcctccgacgttcggtggaggcaccaagctggaaatcaaacgg

SEQ ID NO: 479 - DNA, 324 bp, Artificial Sequence
  Synthetic Construct
gacatccagatgactcagtctccagcttcactgtctgcatctgtgggagaaactgtcaccatcacatgtggagcaagtgagaatatttacggtgctttaaattggtatcagcggaaacagggaaaatctcctcagctcctgatctatggtgcaaccaacttggcagatggcatgtcatcgaggttcagtggcagtggatctggtagacagtattctctcaagatcagtagcctgcatcctgacgatgttgcaacgtattactgtcaaaatgtgttaagtactccgtggacgttcggtggaggcaccaagctggaaatcaaacgg

SEQ ID NO: 480 - DNA, 336 bp, Artificial Sequence
  Synthetic Construct
gacattgtgctgacccaatctccagcttctttggctgtgtctctagggcagagggccaccatctcctgcaaggccagccaaagtgttgattatgatggtgatagttatatgaactggtaccaacagaaaccaggacagccacccaaactcctcatctatgctgcatccaatctagaatctgggatcccagccaggtttagtggcagtgggtctgggacagacttcaccctcaacatccatcctgtggaggaggaggatgctgcaacctattactgtcagcaaagtaatgaggatccattcacgttcggctcggggacaaagttggaaataaaacgg

SEQ ID NO: 481 - DNA, 321 bp, Artificial Sequence
  Synthetic Construct
gatattgtgctgacacagtctccagcaatcatgtctgcatctccaggggagaaggtcaccatatcctgcagtgccagctcaagtgtaagttacatgtactggtaccagcagaagccaggatcctcccccaaaccctggatttatcgcacatccaacctggcttctggagtccctgctcgcttcagtggcagtgggtctgggacctcttactctctcacaatcagcagcatggaggctgaagatgctgccacttattactgccagcagtatcatagttacccgtacacgttcggaggggggaccaagctggaaataaaacgg

SEQ ID NO: 482 - DNA, 324 bp, Artificial Sequence
  Synthetic Construct
gatgtccagataacccagtctccatcttatcttgctgcatctcctggagaaaccattactattaattgcagggcaagtaagagcattagcaaatatttagcctggtatcaagagaaacctgggaaaactaataagcttcttatctactctggatccactttgcaatctggaattccatcaaggttcagtggcagtggatctggtacagatttcactctcaccatcagtagcctggagcctgaagattttgcaatgtattactgtcaacagcataatgaatacccgtggacgttcggtggaggcaccaagctggaaatcaaacgg

SEQ ID NO: 483 - DNA, 321 bp, Artificial Sequence
  Synthetic Construct
caaattgttctcacccagtctccagtaatcatgtctgcatctccaggggagaaggtcaccatgacctgcagtgccagctcaagtgtaagtgacatgcactggtaccagcagaagtcaggcacctcccccaaaagatggatttatgacacatccaaactggcttctggagtccctgctcgcttcagtggcagtgggtctgggacctcttactctctcacaatcagcagcatggaggctgaagatgctgccacttattactgccagcagtggagtagtaacccgctcacgttcggtgctgggaccaagctggagctgaaacgg

SEQ ID NO: 484 - DNA, 333 bp, Artificial Sequence
  Synthetic Construct
aacattgtgctgacccaatctccagcttctttggctgtgtctctagggcagagggccaccatatcctgcagagccagtgaaagtgttgatagttatggcaatagttttatgcactggtaccagcagaaaccaggacagccacccaaactcctcatctatcttgcatccaacctagaatctggggtccctgccaggttcagtggcagtgggtctaggacagacttcaccctcaccattgatcctgtggaggctgatgatgctgcaacctattactgtcagcaaaataatgaggatccgtggacgttcggtggaggcaccaagctggaaatcaaa

SEQ ID NO: 485 - DNA, 339 bp, Artificial Sequence
  Synthetic Construct
gatgttgtgatgacccaaagtccactctccctgcctgtcagtctaggagatcaagcctccatctcttgcagatctagtcagagccttgtacacagtaatggaaacacctatttacattggtacctgcagaagccaggccagtctccaaagctcctgatctacaaagtttccaaccgattttctggggtcccagacaggttcagtggcagtggatcagggacagatttcacactcaagatcagcagagtggaggctgaggatctgggagtttatttctgctctcaaagtacacatgtttcgtacacgttcggaggggggaccaaactggaaataaaacgg

SEQ ID NO: 486 - protein, 240 aa, Artificial Sequence
  Synthetic Construct
QVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSSGGGGSGGGGSGGGGSDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKR

SEQ ID NO: 487 - protein, 235 aa, Artificial Sequence
  Synthetic Construct
QVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSSGGGGSGGGGSGGGGSDIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKR

SEQ ID NO: 488 - protein, 239 aa, Artificial Sequence
  Synthetic Construct
QVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSSGGGGSGGGGSGGGGSDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKR

SEQ ID NO: 489 - protein, 234 aa, Artificial Sequence
  Synthetic Construct
QVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSSGGGGSGGGGSGGGGSDIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKR

SEQ ID NO: 490 - protein, 235 aa, Artificial Sequence
  Synthetic Construct
QVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSSGGGGSGGGGSGGGGSDVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKR

SEQ ID NO: 491 - protein, 234 aa, Artificial Sequence
  Synthetic Construct
QVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSSGGGGSGGGGSGGGGSQIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKR

SEQ ID NO: 492 - protein, 238 aa, Artificial Sequence
  Synthetic Construct
QVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSSGGGGSGGGGSGGGGSNIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIK

SEQ ID NO: 493 - protein, 240 aa, Artificial Sequence
  Synthetic Construct
QVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSSGGGGSGGGGSGGGGSDVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKR

SEQ ID NO: 494 - protein, 240 aa, Artificial Sequence
  Synthetic Construct
EVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICLGGGGSGGGGSGGGGSDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKR

SEQ ID NO: 495 - protein, 235 aa, Artificial Sequence
  Synthetic Construct
EVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICLGGGGSGGGGSGGGGSDIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKR

SEQ ID NO: 496 - protein, 239 aa, Artificial Sequence
  Synthetic Construct
EVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICLGGGGSGGGGSGGGGSDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKR

SEQ ID NO: 497 - protein, 234 aa, Artificial Sequence
  Synthetic Construct
EVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICLGGGGSGGGGSGGGGSDIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKR

SEQ ID NO: 498 - protein, 235 aa, Artificial Sequence
  Synthetic Construct
EVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICLGGGGSGGGGSGGGGSDVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKR

SEQ ID NO: 499 - protein, 234 aa, Artificial Sequence
  Synthetic Construct
EVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICLGGGGSGGGGSGGGGSQIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKR

SEQ ID NO: 500 - protein, 238 aa, Artificial Sequence
  Synthetic Construct
EVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICLGGGGSGGGGSGGGGSNIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIK

SEQ ID NO: 501 - protein, 240 aa, Artificial Sequence
  Synthetic Construct
EVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICLGGGGSGGGGSGGGGSDVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKR

SEQ ID NO: 502 - protein, 245 aa, Artificial Sequence
  Synthetic Construct
VKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSSGGGGSGGGGSGGGGSDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKR

SEQ ID NO: 503 - protein, 240 aa, Artificial Sequence
  Synthetic Construct
VKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSSGGGGSGGGGSGGGGSDIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKR

SEQ ID NO: 504 - protein, 244 aa, Artificial Sequence
  Synthetic Construct
VKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSSGGGGSGGGGSGGGGSDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKR

SEQ ID NO: 505 - protein, 239 aa, Artificial Sequence
  Synthetic Construct
VKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSSGGGGSGGGGSGGGGSDIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKR

SEQ ID NO: 506 - protein, 240 aa, Artificial Sequence
  Synthetic Construct
VKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSSGGGGSGGGGSGGGGSDVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKR

SEQ ID NO: 507 - protein, 239 aa, Artificial Sequence
  Synthetic Construct
VKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSSGGGGSGGGGSGGGGSQIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKR

SEQ ID NO: 508 - protein, 243 aa, Artificial Sequence
  Synthetic Construct
VKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSSGGGGSGGGGSGGGGSNIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIK

SEQ ID NO: 509 - protein, 245 aa, Artificial Sequence
  Synthetic Construct
VKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSSGGGGSGGGGSGGGGSDVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKR

SEQ ID NO: 510 - protein, 242 aa, Artificial Sequence
  Synthetic Construct
VQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSSGGGGSGGGGSGGGGSDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKR

SEQ ID NO: 511 - protein, 237 aa, Artificial Sequence
  Synthetic Construct
VQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSSGGGGSGGGGSGGGGSDIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKR

SEQ ID NO: 512 - protein, 241 aa, Artificial Sequence
  Synthetic Construct
VQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSSGGGGSGGGGSGGGGSDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKR

SEQ ID NO: 513 - protein, 236 aa, Artificial Sequence
  Synthetic Construct
VQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSSGGGGSGGGGSGGGGSDIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKR

SEQ ID NO: 514 - protein, 237 aa, Artificial Sequence
  Synthetic Construct
VQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSSGGGGSGGGGSGGGGSDVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKR

SEQ ID NO: 515 - protein, 236 aa, Artificial Sequence
  Synthetic Construct
VQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSSGGGGSGGGGSGGGGSQIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKR

SEQ ID NO: 516 - protein, 240 aa, Artificial Sequence
  Synthetic Construct
VQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSSGGGGSGGGGSGGGGSNIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIK

SEQ ID NO: 517 - protein, 242 aa, Artificial Sequence
  Synthetic Construct
VQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSSGGGGSGGGGSGGGGSDVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKR

SEQ ID NO: 518 - protein, 246 aa, Artificial Sequence
  Synthetic Construct
VQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSSGGGGSGGGGSGGGGSDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKR

SEQ ID NO: 519 - protein, 241 aa, Artificial Sequence
  Synthetic Construct
VQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSSGGGGSGGGGSGGGGSDIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKR

SEQ ID NO: 520 - protein, 245 aa, Artificial Sequence
  Synthetic Construct
VQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSSGGGGSGGGGSGGGGSDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKR

SEQ ID NO: 521 - protein, 240 aa, Artificial Sequence
  Synthetic Construct
VQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSSGGGGSGGGGSGGGGSDIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKR

SEQ ID NO: 522 - protein, 241 aa, Artificial Sequence
  Synthetic Construct
VQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSSGGGGSGGGGSGGGGSDVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKR

SEQ ID NO: 523 - protein, 240 aa, Artificial Sequence
  Synthetic Construct
VQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSSGGGGSGGGGSGGGGSQIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKR

SEQ ID NO: 524 - protein, 244 aa, Artificial Sequence
  Synthetic Construct
VQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSSGGGGSGGGGSGGGGSNIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIK

SEQ ID NO: 525 - protein, 246 aa, Artificial Sequence
  Synthetic Construct
VQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSSGGGGSGGGGSGGGGSDVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKR

SEQ ID NO: 526 - protein, 257 aa, Artificial Sequence
  Synthetic Construct
QVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSAGGGGSGGGGSGGGGSDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKR

SEQ ID NO: 527 - protein, 252 aa, Artificial Sequence
  Synthetic Construct
QVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSAGGGGSGGGGSGGGGSDIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKR

SEQ ID NO: 528 - protein, 256 aa, Artificial Sequence
  Synthetic Construct
QVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSAGGGGSGGGGSGGGGSDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKR

SEQ ID NO: 529 - protein, 251 aa, Artificial Sequence
  Synthetic Construct
QVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSAGGGGSGGGGSGGGGSDIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKR

SEQ ID NO: 530 - protein, 252 aa, Artificial Sequence
  Synthetic Construct
QVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSAGGGGSGGGGSGGGGSDVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKR

SEQ ID NO: 531 - protein, 251 aa, Artificial Sequence
  Synthetic Construct
QVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSAGGGGSGGGGSGGGGSQIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKR

SEQ ID NO: 532 - protein, 255 aa, Artificial Sequence
  Synthetic Construct
QVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSAGGGGSGGGGSGGGGSNIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIK

SEQ ID NO: 533 - protein, 257 aa, Artificial Sequence
  Synthetic Construct
QVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSAGGGGSGGGGSGGGGSDVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKR

SEQ ID NO: 534 - protein, 251 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSSGGGGSGGGGSGGGGSDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKR

SEQ ID NO: 535 - protein, 246 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSSGGGGSGGGGSGGGGSDIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKR

SEQ ID NO: 536 - protein, 250 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSSGGGGSGGGGSGGGGSDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKR

SEQ ID NO: 537 - protein, 245 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSSGGGGSGGGGSGGGGSDIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKR

SEQ ID NO: 538 - protein, 246 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSSGGGGSGGGGSGGGGSDVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKR

SEQ ID NO: 539 - protein, 245 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSSGGGGSGGGGSGGGGSQIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKR

SEQ ID NO: 540 - protein, 249 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSSGGGGSGGGGSGGGGSNIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIK

SEQ ID NO: 541 - protein, 251 aa, Artificial Sequence
  Synthetic Construct
DVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSSGGGGSGGGGSGGGGSDVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKR

SEQ ID NO: 542 - protein, 250 aa, Artificial Sequence
  Synthetic Construct
EVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSSGGGGSGGGGSGGGGSDVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKR

SEQ ID NO: 543 - protein, 245 aa, Artificial Sequence
  Synthetic Construct
EVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSSGGGGSGGGGSGGGGSDIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKR

SEQ ID NO: 544 - protein, 249 aa, Artificial Sequence
  Synthetic Construct
EVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSSGGGGSGGGGSGGGGSDIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKR

SEQ ID NO: 545 - protein, 244 aa, Artificial Sequence
  Synthetic Construct
EVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSSGGGGSGGGGSGGGGSDIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKR

SEQ ID NO: 546 - protein, 245 aa, Artificial Sequence
  Synthetic Construct
EVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSSGGGGSGGGGSGGGGSDVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKR

SEQ ID NO: 547 - protein, 244 aa, Artificial Sequence
  Synthetic Construct
EVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSSGGGGSGGGGSGGGGSQIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKR

SEQ ID NO: 548 - protein, 248 aa, Artificial Sequence
  Synthetic Construct
EVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSSGGGGSGGGGSGGGGSNIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIK

SEQ ID NO: 549 - protein, 250 aa, Artificial Sequence
  Synthetic Construct
EVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSSGGGGSGGGGSGGGGSDVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKR

SEQ ID NO: 550 - protein, 240 aa, Artificial Sequence
  Synthetic Construct
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKRGGGGSGGGGSGGGGSQVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSS

SEQ ID NO: 551 - protein, 240 aa, Artificial Sequence
  Synthetic Construct
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKRGGGGSGGGGSGGGGSEVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICL

SEQ ID NO: 552 - protein, 245 aa, Artificial Sequence
  Synthetic Construct
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKRGGGGSGGGGSGGGGSVKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSS

SEQ ID NO: 553 - protein, 242 aa, Artificial Sequence
  Synthetic Construct
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKRGGGGSGGGGSGGGGSVQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSS

SEQ ID NO: 554 - protein, 246 aa, Artificial Sequence
  Synthetic Construct
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKRGGGGSGGGGSGGGGSVQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSS

SEQ ID NO: 555 - protein, 257 aa, Artificial Sequence
  Synthetic Construct
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKRGGGGSGGGGSGGGGSQVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSA

SEQ ID NO: 556 - protein, 251 aa, Artificial Sequence
  Synthetic Construct
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKRGGGGSGGGGSGGGGSDVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSS

SEQ ID NO: 557 - protein, 250 aa, Artificial Sequence
  Synthetic Construct
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPPTFGGGTKLEIKRGGGGSGGGGSGGGGSEVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSS

SEQ ID NO: 558 - protein, 235 aa, Artificial Sequence
  Synthetic Construct
DIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKRGGGGSGGGGSGGGGSQVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSS

SEQ ID NO: 559 - protein, 235 aa, Artificial Sequence
  Synthetic Construct
DIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKRGGGGSGGGGSGGGGSEVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICL

SEQ ID NO: 560 - protein, 240 aa, Artificial Sequence
  Synthetic Construct
DIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKRGGGGSGGGGSGGGGSVKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSS

SEQ ID NO: 561 - protein, 237 aa, Artificial Sequence
  Synthetic Construct
DIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKRGGGGSGGGGSGGGGSVQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSS

SEQ ID NO: 562 - protein, 241 aa, Artificial Sequence
  Synthetic Construct
DIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKRGGGGSGGGGSGGGGSVQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSS

SEQ ID NO: 563 - protein, 252 aa, Artificial Sequence
  Synthetic Construct
DIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKRGGGGSGGGGSGGGGSQVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSA

SEQ ID NO: 564 - protein, 246 aa, Artificial Sequence
  Synthetic Construct
DIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKRGGGGSGGGGSGGGGSDVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSS

SEQ ID NO: 565 - protein, 245 aa, Artificial Sequence
  Synthetic Construct
DIQMTQSPASLSASVGETVTITCGASENIYGALNWYQRKQGKSPQLLIYGATNLADGMSSRFSGSGSGRQYSLKISSLHPDDVATYYCQNVLSTPWTFGGGTKLEIKRGGGGSGGGGSGGGGSEVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSS

SEQ ID NO: 566 - protein, 239 aa, Artificial Sequence
  Synthetic Construct
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKRGGGGSGGGGSGGGGSQVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSS

SEQ ID NO: 567 - protein, 239 aa, Artificial Sequence
  Synthetic Construct
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKRGGGGSGGGGSGGGGSEVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICL

SEQ ID NO: 568 - protein, 244 aa, Artificial Sequence
  Synthetic Construct
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKRGGGGSGGGGSGGGGSVKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSS

SEQ ID NO: 569 - protein, 241 aa, Artificial Sequence
  Synthetic Construct
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKRGGGGSGGGGSGGGGSVQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSS

SEQ ID NO: 570 - protein, 245 aa, Artificial Sequence
  Synthetic Construct
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKRGGGGSGGGGSGGGGSVQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSS

SEQ ID NO: 571 - protein, 256 aa, Artificial Sequence
  Synthetic Construct
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKRGGGGSGGGGSGGGGSQVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSA

SEQ ID NO: 572 - protein, 250 aa, Artificial Sequence
  Synthetic Construct
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKRGGGGSGGGGSGGGGSDVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSS

SEQ ID NO: 573 - protein, 249 aa, Artificial Sequence
  Synthetic Construct
DIVLTQSPASLAVSLGQRATISCKASQSVDYDGDSYMNWYQQKPGQPPKLLIYAASNLESGIPARFSGSGSGTDFTLNIHPVEEEDAATYYCQQSNEDPFTFGSGTKLEIKRGGGGSGGGGSGGGGSEVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSS

SEQ ID NO: 574 - protein, 234 aa, Artificial Sequence
  Synthetic Construct
DIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKRGGGGSGGGGSGGGGSQVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSS

SEQ ID NO: 575 - protein, 234 aa, Artificial Sequence
  Synthetic Construct
DIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKRGGGGSGGGGSGGGGSEVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICL

SEQ ID NO: 576 - protein, 239 aa, Artificial Sequence
  Synthetic Construct
DIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKRGGGGSGGGGSGGGGSVKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSS

SEQ ID NO: 577 - protein, 236 aa, Artificial Sequence
  Synthetic Construct
DIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKRGGGGSGGGGSGGGGSVQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSS

SEQ ID NO: 578 - protein, 240 aa, Artificial Sequence
  Synthetic Construct
DIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKRGGGGSGGGGSGGGGSVQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSS

SEQ ID NO: 579 - protein, 251 aa, Artificial Sequence
  Synthetic Construct
DIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKRGGGGSGGGGSGGGGSQVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSA

SEQ ID NO: 580 - protein, 245 aa, Artificial Sequence
  Synthetic Construct
DIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKRGGGGSGGGGSGGGGSDVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSS

SEQ ID NO: 581 - protein, 244 aa, Artificial Sequence
  Synthetic Construct
DIVLTQSPAIMSASPGEKVTISCSASSSVSYMYWYQQKPGSSPKPWIYRTSNLASGVPARFSGSGSGTSYSLTISSMEAEDAATYYCQQYHSYPYTFGGGTKLEIKRGGGGSGGGGSGGGGSEVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSS

SEQ ID NO: 582 - protein, 235 aa, Artificial Sequence
  Synthetic Construct
DVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKRGGGGSGGGGSGGGGSQVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSS

SEQ ID NO: 583 - protein, 235 aa, Artificial Sequence
  Synthetic Construct
DVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKRGGGGSGGGGSGGGGSEVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICL

SEQ ID NO: 584 - protein, 240 aa, Artificial Sequence
  Synthetic Construct
DVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKRGGGGSGGGGSGGGGSVKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSS

SEQ ID NO: 585 - protein, 237 aa, Artificial Sequence
  Synthetic Construct
DVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKRGGGGSGGGGSGGGGSVQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSS

SEQ ID NO: 586 - protein, 241 aa, Artificial Sequence
  Synthetic Construct
DVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKRGGGGSGGGGSGGGGSVQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSS

SEQ ID NO: 587 - protein, 252 aa, Artificial Sequence
  Synthetic Construct
DVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKRGGGGSGGGGSGGGGSQVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSA

SEQ ID NO: 588 - protein, 246 aa, Artificial Sequence
  Synthetic Construct
DVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKRGGGGSGGGGSGGGGSDVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSS

SEQ ID NO: 589 - protein, 245 aa, Artificial Sequence
  Synthetic Construct
DVQITQSPSYLAASPGETITINCRASKSISKYLAWYQEKPGKTNKLLIYSGSTLQSGIPSRFSGSGSGTDFTLTISSLEPEDFAMYYCQQHNEYPWTFGGGTKLEIKRGGGGSGGGGSGGGGSEVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSS

SEQ ID NO: 590 - protein, 234 aa, Artificial Sequence
  Synthetic Construct
QIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKRGGGGSGGGGSGGGGSQVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSS

SEQ ID NO: 591 - protein, 234 aa, Artificial Sequence
  Synthetic Construct
QIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKRGGGGSGGGGSGGGGSEVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICL

SEQ ID NO: 592 - protein, 239 aa, Artificial Sequence
  Synthetic Construct
QIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKRGGGGSGGGGSGGGGSVKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSS

SEQ ID NO: 593 - protein, 236 aa, Artificial Sequence
  Synthetic Construct
QIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKRGGGGSGGGGSGGGGSVQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSS

SEQ ID NO: 594 - protein, 240 aa, Artificial Sequence
  Synthetic Construct
QIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKRGGGGSGGGGSGGGGSVQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSS

SEQ ID NO: 595 - protein, 251 aa, Artificial Sequence
  Synthetic Construct
QIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKRGGGGSGGGGSGGGGSQVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSA

SEQ ID NO: 596 - protein, 245 aa, Artificial Sequence
  Synthetic Construct
QIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKRGGGGSGGGGSGGGGSDVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSS

SEQ ID NO: 597 - protein, 244 aa, Artificial Sequence
  Synthetic Construct
QIVLTQSPVIMSASPGEKVTMTCSASSSVSDMHWYQQKSGTSPKRWIYDTSKLASGVPARFSGSGSGTSYSLTISSMEAEDAATYYCQQWSSNPLTFGAGTKLELKRGGGGSGGGGSGGGGSEVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSS

SEQ ID NO: 598 - protein, 238 aa, Artificial Sequence
  Synthetic Construct
NIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIKGGGGSGGGGSGGGGSQVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSS

SEQ ID NO: 599 - protein, 238 aa, Artificial Sequence
  Synthetic Construct
NIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIKGGGGSGGGGSGGGGSEVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICL

SEQ ID NO: 600 - protein, 243 aa, Artificial Sequence
  Synthetic Construct
NIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIKGGGGSGGGGSGGGGSVKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSS

SEQ ID NO: 601 - protein, 240 aa, Artificial Sequence
  Synthetic Construct
NIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIKGGGGSGGGGSGGGGSVQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSS

SEQ ID NO: 602 - protein, 244 aa, Artificial Sequence
  Synthetic Construct
NIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIKGGGGSGGGGSGGGGSVQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSS

SEQ ID NO: 603 - protein, 255 aa, Artificial Sequence
  Synthetic Construct
NIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIKGGGGSGGGGSGGGGSQVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSA

SEQ ID NO: 604 - protein, 249 aa, Artificial Sequence
  Synthetic Construct
NIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIKGGGGSGGGGSGGGGSDVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSS

SEQ ID NO: 605 - protein, 248 aa, Artificial Sequence
  Synthetic Construct
NIVLTQSPASLAVSLGQRATISCRASESVDSYGNSFMHWYQQKPGQPPKLLIYLASNLESGVPARFSGSGSRTDFTLTIDPVEADDAATYYCQQNNEDPWTFGGGTKLEIKGGGGSGGGGSGGGGSEVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSS

SEQ ID NO: 606 - protein, 240 aa, Artificial Sequence
  Synthetic Construct
DVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKRGGGGSGGGGSGGGGSQVKLQQSGAELGKPGTSVKLSCKASGYTFTSYWMHWVKQRPGQGLEWIGNINPNSGSTNYNEKFKSKATLTVDKSSSTAYMQLSTLTSEDSAVYYCTRPGVWGTGTTVTVSS

SEQ ID NO: 607 - protein, 240 aa, Artificial Sequence
  Synthetic Construct
DVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKRGGGGSGGGGSGGGGSEVKLQQSGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICL

SEQ ID NO: 608 - protein, 245 aa, Artificial Sequence
  Synthetic Construct
DVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKRGGGGSGGGGSGGGGSVKLLESGGGLVQPGGSLKLSCAASGFEFSRYWMSWVRQVPGKGLEWIGEVNPDSSTINYTTSLKDKFIISRDNAKNTLYLQMSKVRSEDTALYYCGRDSNYGYFDVWGTGTTVTVSS

SEQ ID NO: 609 - protein, 242 aa, Artificial Sequence
  Synthetic Construct
DVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKRGGGGSGGGGSGGGGSVQLKESGPGLVAPSQSLSITCTVSGFSLTGYGVNWVRQPPGKGLEWLGMIWGDGSTDYNSALKSRLSISKDNSKSQVFLKMNSLQTDDTARYYCARGGYDFDYWGQGTTLTVSS

SEQ ID NO: 610 - protein, 246 aa, Artificial Sequence
  Synthetic Construct
DVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKRGGGGSGGGGSGGGGSVQLQQSGAELARPGASVKMSCKASGYTFTSYWMHWVKQRPGQGLEWIGAIYPGNSDTSYNQKFKGKAKLTAVTSASTAYMELSSLTNEDSAVYYCTRSHYVEGYFDVWGTGTTVTVSS

SEQ ID NO: 611 - protein, 257 aa, Artificial Sequence
  Synthetic Construct
DVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKRGGGGSGGGGSGGGGSQVKLQQSGAELVKPGASVKISCKASGYAFSSSWMNWVKQRPGKGLEWIGQIYPGDGDTKYNGKFKGKATLTADKSSSTAYMQLSSLTSEDSAVYFCANSNYPSSQSSRTYSRRDWFAYWGQGTLVTVSA

SEQ ID NO: 612 - protein, 251 aa, Artificial Sequence
  Synthetic Construct
DVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKRGGGGSGGGGSGGGGSDVKLQESGGGLVKPGGSLKLSCAVSGFTFSSFAMSWVRQTPEKRLEWVATISSGGAYTFYKDSVKGRFTISRDNAKNTLYLQMSSLRSEDSAMYYCARHSGYDGYYLYAMDCWGQGTSVTVSS

SEQ ID NO: 613 - protein, 250 aa, Artificial Sequence
  Synthetic Construct
DVVMTQSPLSLPVSLGDQASISCRSSQSLVHSNGNTYLHWYLQKPGQSPKLLIYKVSNRFSGVPDRFSGSGSGTDFTLKISRVEAEDLGVYFCSQSTHVSYTFGGGTKLEIKRGGGGSGGGGSGGGGSEVKLQQSGGGLVKPGASLKLSCAASGFTFSNYGMSWVRQTSDKRLEWVASISSGGGRIYYPDNVKGRFTISRENAKNTLYLQMNSLKSDDTALYYCAREPPNYYGGTYGDYWGQGTTLTVSS

What is claimed is:

1. A chimeric antigen receptor (CAR) polypeptide, comprising a CD19 antigen binding domain; an intracellular signaling domain; and a co-stimulatory signaling region,
   wherein the CD19 antigen binding domain is a single-chain variable fragment (scFv) of an antibody that specifically binds CD19 comprising a variable heavy ($V_H$) domain having CDR1, CDR2 and CDR3 sequences and a variable light ($V_L$) domain having CDR1, CDR2 and CDR3 sequences, and
   wherein the CDR1 sequence of the $V_H$ domain comprises the amino acid sequence SEQ ID NO:1; the CDR2 sequence of the $V_H$ domain comprises the amino acid sequence SEQ ID NO:9; the CDR3 sequence of the $V_H$ domain comprises the amino acid sequence SEQ ID NO:19; the CDR1 sequence of the $V_L$ comprises the amino acid sequence SEQ ID NO:29; the CDR2 sequence of the $V_L$ domain comprises the amino acid sequence SEQ ID NO:38; and the CDR3 sequence of the $V_L$ domain comprises the amino acid sequence SEQ ID NO:43;
   wherein the CDR1 sequence of the $V_H$ domain comprises the amino acid sequence SEQ ID NO:1; the CDR2 sequence of the $V_H$ domain comprises the amino acid sequence SEQ ID NO:10; the CDR3 sequence of the $V_H$ domain comprises the amino acid sequence SEQ ID NO:20; the CDR1 sequence of the $V_L$ comprises the amino acid sequence SEQ ID NO:30; the CDR2 sequence of the $V_L$ domain comprises the amino acid sequence SEQ ID NO:39; and the CDR3 sequence of the $V_L$ domain comprises the amino acid sequence SEQ ID NO:44;
   wherein the CDR1 sequence of the $V_H$ domain comprises the amino acid sequence SEQ ID NO:2; the CDR2 sequence of the $V_H$ domain comprises the amino acid sequence SEQ ID NO:11; the CDR3 sequence of the $V_H$ domain comprises the amino acid sequence SEQ ID NO:21; the CDR1 sequence of the $V_L$ comprises the amino acid sequence SEQ ID NO:31; the CDR2 sequence of the $V_L$ domain comprises the amino acid sequence SEQ ID NO:38; and the CDR3 sequence of the $V_L$ domain comprises the amino acid sequence SEQ ID NO:45;
   wherein the CDR1 sequence of the $V_H$ domain comprises the amino acid sequence SEQ ID NO:3; the CDR2 sequence of the $V_H$ domain comprises the amino acid sequence SEQ ID NO:12; the CDR3 sequence of the $V_H$ domain comprises the amino acid sequence SEQ ID NO:22; the CDR1 sequence of the $V_L$ comprises the amino acid sequence SEQ ID NO:32; the CDR2 sequence of the $V_L$ domain comprises the amino acid sequence SEQ ID NO:40; and the CDR3 sequence of the $V_L$ domain comprises the amino acid sequence SEQ ID NO:46;
   wherein the CDR1 sequence of the $V_H$ domain comprises the amino acid sequence SEQ ID NO:4; the CDR2 sequence of the $V_H$ domain comprises the amino acid sequence SEQ ID NO:13; the CDR3 sequence of the $V_H$ domain comprises the amino acid sequence SEQ ID NO:23; the CDR1 sequence of the $V_L$ comprises the amino acid sequence SEQ ID NO:33; the CDR2 sequence of the $V_L$ domain comprises the amino acid sequence SEQ ID NO:38; and the CDR3 sequence of the $V_L$ domain comprises the amino acid SEQ ID NO:47;
   wherein the CDR1 sequence of the $V_H$ domain comprises the amino acid sequence SEQ ID NO:5; the CDR2 sequence of the $V_H$ domain comprises the amino acid sequence SEQ ID NO:14; the CDR3 sequence of the $V_H$ domain comprises the amino acid sequence SEQ ID NO:24; the CDR1 sequence of the $V_L$ comprises the amino acid sequence SEQ ID NO:34; the CDR2 sequence of the $V_L$ domain comprises the amino acid sequence SEQ ID NO:41; and the CDR3 sequence of the $V_L$ domain comprises the amino acid sequence SEQ ID NO:48;
   wherein the CDR1 sequence of the $V_H$ domain comprises the amino acid sequence SEQ ID NO:6; the CDR2 sequence of the $V_H$ domain comprises the amino acid sequence SEQ ID NO:15; the CDR3 sequence of the $V_H$ domain comprises the amino acid sequence SEQ ID NO:25; the CDR1 sequence of the $V_L$ comprises the amino acid sequence SEQ ID NO:35; the CDR2 sequence of the $V_L$ domain comprises the amino acid sequence SEQ ID NO:40; and the CDR3 sequence of the $V_L$ domain comprises the amino acid sequence SEQ ID NO:49;
   wherein the CDR1 sequence of the $V_H$ domain comprises the amino acid sequence SEQ ID NO:8; the CDR2 sequence of the $V_H$ domain comprises the amino acid sequence SEQ ID NO:17; the CDR3 sequence of the $V_H$ domain comprises the amino acid sequence SEQ ID NO:27 the CDR1 sequence of the $V_L$ comprises the amino acid sequence SEQ ID NO:36; the CDR2 sequence of the $V_L$ domain comprises the amino acid sequence SEQ ID NO:41; and the CDR3 sequence of the $V_L$ domain comprises the amino acid sequence SEQ ID NO:50; or
   wherein the CDR1 sequence of the $V_H$ domain comprises the amino acid sequence SEQ ID NO:3; the CDR2 sequence of the $V_H$ domain comprises the amino acid sequence SEQ ID NO:18; the CDR3 sequence of the $V_H$ domain comprises the amino acid sequence SEQ ID NO:28; the CDR1 sequence of the $V_L$ comprises the amino acid sequence SEQ ID NO:37; the CDR2 sequence of the $V_L$ domain comprises the amino acid sequence SEQ ID NO:42; and the CDR3 sequence of the $V_L$ domain comprises the amino acid sequence SEQ ID NO:51.

2. The polypeptide of claim 1, wherein
the anti-CD19 scFv $V_H$ domain comprises the amino acid sequence SEQ ID NO:53 and the anti-CD19 scFv $V_L$ domain comprises the amino acid sequence SEQ ID NO:63, or
the anti-CD19 scFv $V_H$ domain comprises the amino acid sequence SEQ ID NO:54 and the anti-CD19 scFv $V_L$ domain comprises the amino acid sequence SEQ ID NO:64, or
the anti-CD19 scFv $V_H$ domain comprises the amino acid sequence SEQ ID NO:55 and the anti-CD19 scFv $V_L$ domain comprises the amino acid sequence SEQ ID NO:65, or
the anti-CD19 scFv $V_H$ domain comprises the amino acid sequence SEQ ID NO:56 and the anti-CD19 scFv $V_L$ domain comprises the amino acid sequence SEQ ID NO:66, or
the anti-CD19 scFv $V_H$ domain comprises the amino acid sequence SEQ ID NO:57 and the anti-CD19 scFv $V_L$ domain comprises the amino acid sequence SEQ ID NO:67, or
the anti-CD19 scFv $V_H$ domain comprises the amino acid sequence SEQ ID NO:58 and the anti-CD19 scFv $V_L$ domain comprises the amino acid sequence SEQ ID NO:68, or the anti-CD19 scFv $V_H$ domain comprises the amino acid sequence SEQ ID NO:59 and the anti-CD19 scFv $V_L$ domain comprises the amino acid sequence SEQ ID NO:69, or the anti-CD19 scFv $V_H$ domain comprises the amino acid sequence SEQ ID NO:60 and the anti-CD19 scFv $V_L$ domain comprises the amino acid sequence SEQ ID NO:70, or the anti-CD19 scFv $V_H$ domain comprises the amino acid sequence SEQ ID NO:62 and the anti-CD19 scFv $V_L$ domain comprises the amino acid sequence SEQ ID NO:72.

3. The polypeptide of claim 1, wherein the intracellular signaling domain comprises a CD3 zeta (CD3) signaling domain.

4. The polypeptide of claim 1, wherein the costimulatory signaling region comprises the cytoplasmic domain of a costimulatory molecule selected from the group consisting of CD27, CD28, 4-1BB, OX40, CD30, CD40, PD-1, ICOS, lymphocyte function-associated antigen-1 (LFA-1), CD2, CD7, LIGHT, NKG2C, and B7-H3.

5. A CAR T cell comprising at least one of the chimeric antigen receptor polypeptide(s) of claim 1.

6. The CAR T cell of claim 5, wherein the cell is selected from the group consisting of an αβT cell, γδT cell, a Natural Killer (NK) cell, a Natural Killer T (NKT) cell, a B cell, an innate lymphoid cell (ILC), a cytokine induced killer (CIK) cell, a cytotoxic T lymphocyte (CTL), a lymphokine activated killer (LAK) cell, a regulatory T cell, or any combination thereof.

* * * * *